(12) United States Patent
Berndt et al.

(10) Patent No.: US 11,427,640 B1
(45) Date of Patent: Aug. 30, 2022

(54) CCR8 ANTIBODIES FOR THERAPEUTIC APPLICATIONS

(71) Applicants: Bayer Intellectual Property GmbH, Monheim (DE); Bayer Aktiengesellschaft, Leverkusen (DE); Bayer HealthCare LLC, Whippany, NJ (US)

(72) Inventors: Sandra Berndt, Hohen Neuendorf (DE); Katharina Filarsky, Düsseldorf (DE); Sabine Hoff, Potsdam (DE); Helge Roider, Hohen Neuendorf (DE); Uwe Gritzan, Leverkusen (DE); Christian Votsmeier, Cologne (DE); Wiebke Maria Nadler, Langenfeld (DE); Su-Yi Tseng, San Francisco, CA (US)

(73) Assignee: BAYER AKTIENGESELLSCHAFT, Leverkusen (DE)

( * ) Notice: Subject to any disclaimer, the term of this patent is extended or adjusted under 35 U.S.C. 154(b) by 0 days.

(21) Appl. No.: 17/358,841

(22) Filed: Jun. 25, 2021

Related U.S. Application Data

(60) Provisional application No. 62/705,434, filed on Jun. 26, 2020, provisional application No. 62/705,608, filed on Jul. 7, 2020.

(30) Foreign Application Priority Data

Nov. 3, 2020 (EP) .................................... 20205426

(51) Int. Cl.
*C07K 16/28* (2006.01)
*C07K 14/715* (2006.01)
(Continued)

(52) U.S. Cl.
CPC ...... *C07K 16/2866* (2013.01); *A61K 47/6849* (2017.08); *C07K 14/7158* (2013.01);
(Continued)

(58) Field of Classification Search
None
See application file for complete search history.

(56) References Cited

U.S. PATENT DOCUMENTS

| 4,376,110 A | 3/1983 | David et al. |
| 4,510,245 A | 4/1985 | Cousens et al. |
| (Continued) | | |

FOREIGN PATENT DOCUMENTS

| CN | 110835374 A | 2/2020 |
| CN | 113881681 A | 1/2022 |
| (Continued) | | |

OTHER PUBLICATIONS

MacCallum et al.,Antibody-antigen interactions: contact analysis and binding site topography, J. Mol. Biol. 262:732-745, 1996.*
(Continued)

*Primary Examiner* — Claire Kaufman
(74) *Attorney, Agent, or Firm* — Quarles & Brady LLP

(57) ABSTRACT

The present invention relates to tools and methods for the generation of antibodies which specifically bind chemokine receptors, such as CC or CXC chemokine receptors. Provided are isolated sulfated polypeptides and conjugates thereof, which can be used for example as antigens or for off target panning to facilitate the generation of anti-human, anti-cynomolgus, and/or anti-mouse chemokine receptor antibodies, e.g. for the generation of antibodies with fully human CDRs and/or other favorable properties for therapeutic use. The present invention furthermore relates to antibodies and conjugates thereof which can be obtained by applying the aforementioned tools and methods. Provided (Continued)

are antibodies specifically binding to human, cynomolgus and/or murine CCR8 with favorable properties for therapeutic use, such as cross-reactive antibodies, fully human antibodies, low internalizing (including non-internalizing) antibodies, and antibodies efficiently inducing ADCC and/or ADCP in Treg cells.

15 Claims, 76 Drawing Sheets

Specification includes a Sequence Listing.

(51) Int. Cl.
    *A61K 47/68* (2017.01)
    *G01N 33/574* (2006.01)
    *A61K 39/00* (2006.01)
    *A61P 35/00* (2006.01)

(52) U.S. Cl.
    CPC .... *A61K 47/6803* (2017.08); *A61K 2039/505* (2013.01); *A61P 35/00* (2018.01); *C07K 2317/33* (2013.01); *C07K 2317/41* (2013.01); *C07K 2317/732* (2013.01); *C07K 2317/92* (2013.01); *G01N 33/57492* (2013.01)

(56) References Cited

U.S. PATENT DOCUMENTS

| | | | |
|---|---|---|---|
| 4,676,980 | A | 6/1987 | Segal et al. |
| 4,737,456 | A | 4/1988 | Weng et al. |
| 4,968,615 | A | 11/1990 | Koszinowski et al. |
| 5,168,062 | A | 12/1992 | Stinski |
| 5,225,539 | A | 7/1993 | Winter |
| 5,229,275 | A | 7/1993 | Goroff |
| 5,567,610 | A | 10/1996 | Borrebaeck et al. |
| 5,585,089 | A | 12/1996 | Queen et al. |
| 5,693,761 | A | 12/1997 | Queen et al. |
| 5,693,762 | A | 12/1997 | Queen et al. |
| 5,859,205 | A | 1/1999 | Adair et al. |
| 5,939,598 | A | 8/1999 | Kucherlapati et al. |
| 8,642,292 | B2 | 2/2014 | Sandig et al. |
| 9,394,361 | B2 * | 7/2016 | Gozzard ............... A61P 11/06 |
| 10,087,259 | B1 | 10/2018 | Rudensky et al. |
| 2004/0265304 | A1 | 12/2004 | Qin et al. |
| 2008/0274100 | A1 | 11/2008 | Ben-Levy et al. |
| 2009/0220486 | A1 | 9/2009 | Plaksin et al. |
| 2021/0238292 | A1 | 8/2021 | Holland et al. |
| 2021/0277129 | A1 * | 9/2021 | McGrath ............... A61P 35/00 |

FOREIGN PATENT DOCUMENTS

| | | |
|---|---|---|
| EP | 1771471 B1 | 9/2009 |
| EP | 2424569 B1 | 10/2017 |
| EP | 3355935 A1 | 8/2018 |
| EP | 3431105 A1 | 1/2019 |
| WO | 1993008829 A1 | 5/1993 |
| WO | 01/72830 A2 | 10/2001 |
| WO | 03/096020 A2 | 11/2003 |
| WO | 2006052534 A2 | 5/2006 |
| WO | 2007044756 A3 | 6/2007 |
| WO | 2008112640 A2 | 9/2008 |
| WO | 2016096843 A1 | 6/2016 |
| WO | 2017198631 A1 | 11/2017 |
| WO | 2017/218970 A1 | 12/2017 |
| WO | 2018112032 A1 | 6/2018 |
| WO | 2018112033 A1 | 6/2018 |
| WO | 2018181425 A1 | 10/2018 |
| WO | 2019/157098 A1 | 8/2019 |
| WO | 2019149637 A1 | 8/2019 |
| WO | 2019243159 A1 | 12/2019 |
| WO | 2020102240 | 5/2020 |
| WO | 2020138489 A1 | 7/2020 |
| WO | 2021178749 A2 | 9/2021 |
| WO | 2021194942 A1 | 9/2021 |
| WO | 2022000443 A1 | 1/2022 |
| WO | 2022003156 A1 | 1/2022 |
| WO | 2022004760 A1 | 1/2022 |

OTHER PUBLICATIONS

Chen et al., Enhancement and destruction of antibody function by somatic mutation: unequal occurrence is controlled by V gene combinatorial associations, EMBO J. 14(12):2784-2794, 1995.*

Lamminmaki et al., Chrystal structure of a recombinant anti-estradiol Fab fragment in complex with the 17beta-estradiol, J. Biol. Chem. 276:36687-94, 2001.*

Luderman et al., The structural role of receptor tyrosine sulfation in chemokine recognition, Brit. J. Pharmacol. 171:1167-97, 2014.*

Dal Corso et al., "A non-internalizing antibody-drug conjugate based on an anthracycline payload displays potent therapeutic activity in vivo," Journal of Controlled Release 264 (2017): 211-218.

Sanchez, J. et al., "Evaluation and extension of the two-site, two-step model for binding and activation of the chemokine receptor CCR1," Journal of Biological Chemistry 294.10 (2019): 3464-3475.

Seibert, C. et al., "Toward a framework for sulfoproteomics: synthesis and characterization of sulfotyrosine-containing peptides," Peptide Science 90.3 (2008): 459-477.

Staerz, U.D. et al., "Hybrid antibodies can target sites for attack by T cells," Nature 314.6012 (1985): 628-631.

Yu, Y. et al., "Determination of the sites of tyrosine O-sulfation in peptides and proteins," Nature Methods 4.7 (2007): 583-588.

Nelson, A.L et al., "Development trends for human monoclonal antibody therapeutics," Nature Reviews Drug Discovery 2010, 767-774, vol. 9.

Milstein, C. et al., "Hybrid hybridomas and their use in immunohistochemistry," Nature 1986, 537-540, vol. 305.

Lund, J. et al., "Human Fc gamma RI and Fc gamma RII interact with distinct but overlapping sites on human IgG," J Immunol 1991, 2657-2662, 147.

Millard, C.J. et al., "Structural Basis of Receptor Sulfotyrosine Recognition by a CC Chemokine: The N-Terminal Region of CCR3 Bound to CCL11/Eotaxin-1," Structure 2014, 1571-1581, 22.

Lonberg, N., "Human antibodies from transgenic animals," Nature Biotechnology, Sep. 2005, 1117-1125, 23(9).

Lee, C-H. et al., "An engineered human Fc domain that behaves like a pH-toggle switch for ultra-long circulation persistence," Nature Communications 2019, 1-11, 10:5031.

Liu, J. et al., "Tyrosine Sulfation is Prevalent in Human Chemokine Receptors Important in Lung Disease," Am J Respir Cell Mol Biol 2008, 738-743, vol. 38.

Labrun, A.F. et al., "Efficient generation of stable bispecific IgG1 by controlled Fab-arm exchange," PNAS Mar. 2013, 5145-5150, 110(13).

Kraft, T.E. et al., "Heparin chromatography as an in vitro predictor for antibody clearance rate through pinocytosis," mAbs2020, pp. e1683432-1-e1683432-9, 12:1.

Kurose, K. et al., "Phase Ia Study of FoxP3+ CD4 Treg Depletion by Infusion of a Humanized Anti-CCR4 Antibody, KW-0761, in Cancer Patients," Clin Cancer Res 2015, pp. 4327-4336, 21(19).

Kostelny, S.A. et al., "Formation of a bispecific antibody by the use of leucine zippers," J Immunol 1992, 1547-1553, 148.

Klarenbeek, A. et al., "Targeting chemokines and chemokine receptors with antibodies," Drug Discovery Today, 2012, e237-e244, vol 9, No. 4.

Kohler, G. et al., "Continuous cultures of fused cells secreting antibody of predefined specificity," Nature 1975, 495-497, vol. 256.

Klages, K. et al., "Selective Depletion of Foxp3+ Regulatory T Cells Improves Effective Therapeutic Vaccination against Established Melanoma," Cancer Res 2010, 7788-7799, 70(20).

Jones, P.T. et al., "Replacing the complementarity-determining regions in a human antibody with those from a mouse," Nature 1986, 522-525, vol. 321.

(56) References Cited

OTHER PUBLICATIONS

Katz, S. et al., "A summarization approach for Affymetrix GeneChip data using a reference training set from a large, biologically diverse database," BMC Bioinformatics 2006, 7:464.
Jain, T. et al., "Biophysical properties of the clinical-stage antibody landscape," PNAS 2017, 944-949, 114(5).
Islam, S.A et al., "Identification of human CCR8 as a CCL18 receptor," J. Exp. Med. 2013, 1889-1898, vol. 210, No. 10.
Hutchings, C.J. et al., "Opportunities for therapeutic antibodies directed at G-protein-coupled receptors," Nature Reviews | Drug Discovery Nov. 2017, 787-810, vol. 16.
Hsieh, Y-T. et al., "Characterization of FCγRIIIA effector cells used in invitro ADCC bioassay: Comparison of primary NK cells with engineered NK-92 and Jurkat cells," Journal of Immunological Methods 2017, 56-66, 441.
Houben-Weyl, "Methods of Organic Chemistry" vol. E 22, 4th Edition Supplement, Chapter 6, pp. 440-453.
Hotzel, I. et al., "A strategy for risk mitigation of antibodies with fast clearance," mAbs 2012, 753-760, 4:6.
Holt, L.J. et al., "Domain antibodies: proteins for therapy," Trends in Biotechnology, Nov. 2003, 484-490, vol. 21, No. 11.
Zheng, C et al., "Landscape of Infiltrating T Cells in Liver Cancer Revealed by Single-Cell Sequencing," Cell 2017, 1342-1356, 169.
Zhang, Y. et al., "Deep single-cell RNA sequencing data of individual T cells from treatment-naive colorectal cancer patients," Scientific Data 2019, 1-15, 6:131.
Zhang, D. et al., "Scoring System for Tumor-Infiltrating Lymphocytes and Its Prognostic Value for Gastric Cancer," Frontiers in Immunology, Jan. 2019, vol. 10, Article 71.
Zemlin, M. et al., "Expressed Murine and Human CDR-H3 Intervals of Equal Length Exhibit Distinct Repertoires that Differ in their Amino Acid Composition and Predicted Range of Structures," J Mol. Biol. 2003, 733-749, 334.
Zalevsky, J. et al., "Enhanced antibody half-life improves in vivo activity," Nature Biotechnology, Feb. 2010, 157-159, vol. 28, No. 2.
Ye, J. et al., "IgBLAST: an immuniglobulin variable domain sequence analysis tool," Nucleic Acids Research 2013, W34-W40, vol. 41.
Xing, X. et al., "Expression of the Chemokine Receptor Gene, CCR8, is Associated with DUSP22 Rearrangements in Anaplastic Large Cell Lymphoma," Appl Immunihistochem Mol Morphol. 2015, 580-589, 23(8).
Dé pis, F. et al. "Preclinical evaluation of JTX-1811, an anti-CCR8 antibody with enhanced ADCC activity, for preferential depletion of tumor-infiltrating regulatory T cells." Cancer Res. Proceedings: AACR Annual Meeting, Apr. 27, 2020.
Carter, P.J. et al., "Potent antibody therapeutics by design," Nature Reviews Immunology, May 2006, 343-357, vol. 6.
Chari, R.V. et al., "Immunoconjugates Containing Novel Maytansinoids: Promising Anticancer Drugs," Cancer Research, Jan. 1, 1992, 127-131, 52.
Canfield et al., "The Binding Affinity of Human IgG for its High Affinity Fc Receptor Is Determined by Multiple Amino Acids in the CH2 Domain and Is Modulated by the Hinge Region," J. Exp. Med., Jun. 1991, 1483-1491, vol. 173.
Holliger, P. et al., "'Diabodies': Small bivalent and bispecific antibody fragments," Proc. Natl. Acad. Sci, USA, Jul. 1993, 6444-6448, vol. 90.
Herzog, H., "Measurement of Pharmacokinetics of Yttrium-86 Radiopharmaceuticals with PET and Radiation Dose Calculation of Analogous Yttrium-90 Radiotherapeutics," The Journal of Nuclear Medicine, Dec. 1993, 2222-2226, 34:12.
Harding, F.A. et al., "The immunogenicity of humanized and fully human antibodies," mAbs, 2010, 256-265, 2:3.
Wolfson, W., "Amber Codon Flashing Ambrx Augments Proteins with Unnatural Amino Acids," Chemistry & Biology, Oct. 2006, 1011-1012, 13.
Haraya, K. et al., "Improvement of pharmacokinetic properties of therapeutic antibodies by antibody engineering," Drug Metabolism and Pharmacokinetics, 2019, 25-41, 34.
Haque, N.S. et al., "The chemokine receptor CCR8 mediates human endothelial cells chemotaxis induced by I-309 and Kaposi sarcoma herpesvirus-encoded vMIP-I and by lipoprotein(a)-stimulated endothelial cell conditioned medium," Blood, The Journal of the American Society of Hematology 97.1 (2001): 39-45.
Curiel, T.J. et al., "Specific recruitment of regulatory T cells in ovarian carcinoma fosters immune privilege and predicts reduced survival," Nature Medicine, 2004, 942-949, 10:9.
Cyster, J.G., "Blown Away: The Unexpected Role of Lymphotoxin in Lymphoid Organ Development," J Immunol 2014, pp. 2007-2009, 192.
Cupedo, T. et al., "Induction of Secondary and Tertiary Lymphoid Structures in the Skin," Immunity, 2004, 655-667, vol. 21.
Chenivesse, C. et al., "Pulmonary CCL18 Recruits Human Regulatory T Cells," J Immunol 2012, 128-137, 189.
Chothia, C. et al., "Canonical Structures for the Hypervariable Regions of Immunoglobulins," J. Mol. Biol., 1987, 901-917, 196.
Chen, W. et al., "Synthesis of Sulfotyrosine-Containing Peptides by Incorporating Fluorosulfated Tyrosine Using an Fmoc-Based Solid-Phase Strategy," Angew. Chem. 2016, 1867-1870, vol. 128.
Wahl, R.L. et al., "Improved Radioimaging and Tumor Localization with Monoclonal F(ab')2," J Nucl Med 1983, 316-325, 24.
Webb, D.R. et al., "Opportunities for functional selectivity in GPCR antibodies," Biochemical Pharmacology, 2013, 147-152, 85.
Tutt, A. et al., "Trispecific F(ab')3 derivatives that use cooperative signaling via the TCR/CD3 complex and CD2 to activate and redirect resting cytotoxic T cells," J Immunol 1991, 60-69, 147.
Traunecker, A. et al., "Bispecfic single chain molecules (Janusins) target sytotoxic lymphocytes on HIV infected cells," The EMBO Journal 1991, 3655-3659, 10:12.
Pease, J.E. et al., "Chemokine Receptors in Allergy, Inflammation, and Infectious Disease," Top Med Chem. 14, 2015, ed N. Tschammer, Chemokines: Chemokines and Their Receptors in Drug Discovery, 1-40.
Sodee, D.B. et al., "Preliminary Imaging Results Using In-111 Labeled CYT-356 (Prostascintst) in the Detection of Recurrent Prostate Cancer," Clinical Nuclear Medicine, 1996, 759-767, 21(10).
Smyth, M.J. et al., "Targeting regulatory T cells in tumor immunotherapy," Immunology and Cell Biology 2014, 473-474, 92.
Schaerli, P. et al., "A Skin-selective Homing Mechanism for Human Immune Surveillance T Cells," J. Exp. Med. 2004, 1265-1275, 199(9).
Schoch, A. et al., "Charge-mediated influence of the antibody variable domain on FcRn-dependent pharmacokinetics," PNAS 2015, 5997-6002, 112(19).
Riechmann, L. et al., "Single domain antibodies: comparison of camel VH and camelised human VH domains," Journal of Immunological Methods 1999, 25-38, 231.
Riechmann, K. et al., "Reshaping human antibodies for therapy," Nature 1988, 323-327, vol. 332.
Plitas, G. et al., "Preferential expression of the chemokine receptor 8 (CCR8) on regulatory T cells (Treg) infiltrating human breast cancers represents a novel immunotherapeutic target" [abstract]. In: Proceedings of the Thirty-Eighth Annual CTRC-AACR San Antonio Breast Cancer Symposium: Dec. 8-12, 2015; San Antonio, TX. Philadelphia (PA): AACR; Cancer Res 2016; 76(4 Suppl): Abstract nr P4-04-11.
Presta, L.G., "Antibody engineering," Current Opinion in Structural Biology 1992, 593-596, 2.
Plitas, G. et al., "Regulatory T Cells Exhibit Distinct Features in Human Breast Cancer," Immunity 2016, 1122-1134, 45.
Pease, J.E., "Targeting chemokine receptors in allergic disease," Biochem. J. 2011, 11-24, 434.
Pepper, S.D. et al., "The utility of MAS5 expression summary and detection call algorithms," BMC Bioinformatics 2007, pp. 1-12, 8:273.
Nishikawa, H. et al., "Regulatory T cells in tumor immunity," Int. J. Cancer 2010, 759-767, 127.
Brüggemann et al., "Human Antibody Production in Transgenic Animals," Arch. Immunol. Ther. Exp., 2015, 101-108, 63.
Bunschoten, A. et al., "A general sequence independent solid phase method for the site specific synthesis of multiple sulfated-tyrosine containing peptides," Chem. Commun., 2009, 2999-3001, No. 21.

(56) References Cited

OTHER PUBLICATIONS

Brennan et al., "Preparation of Bispecific Antibodies by Chemical Recombination of Monoclonal Immuoglobulin G1 Fragments," Science, Jul. 5, 1985, 81-83, 229(4708).

Barretina, J. et al., "The Cancer Cell Line Encyclopedia enables predictive modelling of anticancer drug sensitivity," Nature, 2012, 603-607, 483.

Barsheshet, Y. et al., "CCR8+FOXp3+ Treg cells as master drivers of immune regulation," PNAS, 2017, 6086-6091, vol. 114, No. 23.

Barington, L. et al., "Role of Conserved Disulfide Bridges and Aromatic Residues in Extracellular Loop 2 of Chemokine Receptor CCR8 for Chemokine and Small Molecule Binding," The Journal of Biological Chemistry, 2016, 16208-16220, vol. 291, No. 31.

Almagro, J.C. et al., "Progress and Challenges in the Design and Clinical Development of Antibodies for Cancer Therapy," Frontiers in Immunology, Jan. 2018, 1-19, vol. 8, Article 1751.

Avery, L.B. et al., "Establishing in vitro in vivo correlations to screen monoclonal anitbodies for physicochemical properties related to favorable human pharmacokinetics," mAbs, 2018, 244-255, 10:2.

Gutierrez, J. et al., "Analysis of Post-translational CCR8 Modifications and Their Influence on Receptor Activity," The Journal of Biological Chemistry, 2004, 14726-14733, 279:15.

Gou, X. et al., "Global characterization of T cells in non-small-cell lung cancer by single-cell sequencing," Nature Medicine, Jul. 2018, 978-985, vol. 24.

Frenzel A. et al., "Phage display-derived human antibodies in clinical development and therapy," mAbs, 2016, 1177-1194, 8:7.

Gruber, M. et al., "Efficient tumor cell lysis mediated by a bispecific single chain antibody expressed in *Escherichia coli*," J Immunol, 1994, 5368-5374, 152.

Fox, J.M. et al., "Structure/Function Relationships of CCR8 Agonists and Antagonists Amino-Terminal Extension of CCL1 by a Single Amino Acid Generates a Partial Agonist," The Journal of Biological Chemistry, 2006, 26652-36661, 381:48.

Dieu-Nosjean, M-C. et al., "Tertiary lymphoid structures, drivers of the anti-tumor responses in human cancers," Immunological Reviews, 2016, 260-275, 271.

Kremer, L. et al., "Generation of Monoclonal Antibodies Against Chemokine Receptors," Methods in Molecular Biology, vol. 239: Cell Migration in Inflammation and Immunity, eds. D. D'Ambrosio and D. Sinigaglia, 2004, Humana Press, Inc., Totowa, NJ.

De Simone, M. et al., "Transcriptional Landscape of Human Tissue Lymphocytes Unveils Uniqueness of Tumor-Infiltrating T Regulatory Cells," Immunity, 2016, 1135-1147, 45.

Dall' Acqua, W.F. et al., "Increasing the Affinity of a Human IgG1 for the Neonatal Fc Receptor: Biological Consequences," J Immunol, 2002, 5171-5180, 169.

Monigatti, F. et al., "The Sulfinator: predicting tyrosine sulfation sites in protein sequences," Bioinformatics Applications Note 2002, pp. 769-770, 18(5).

\* cited by examiner

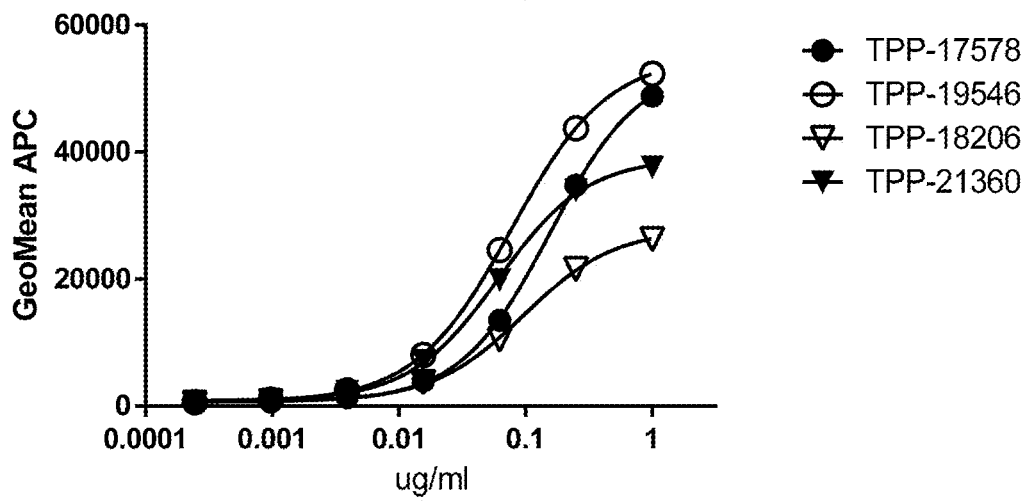
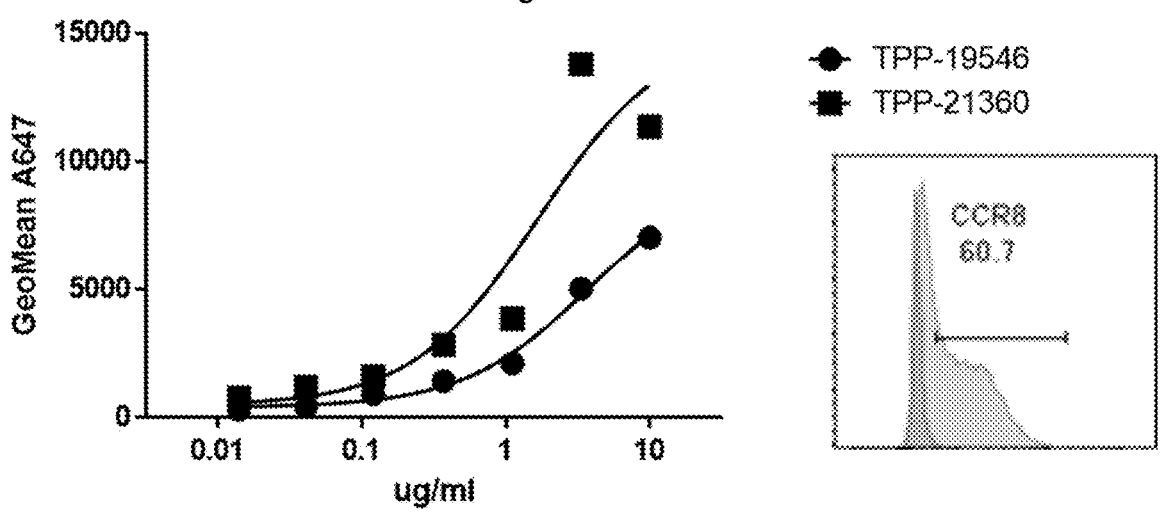
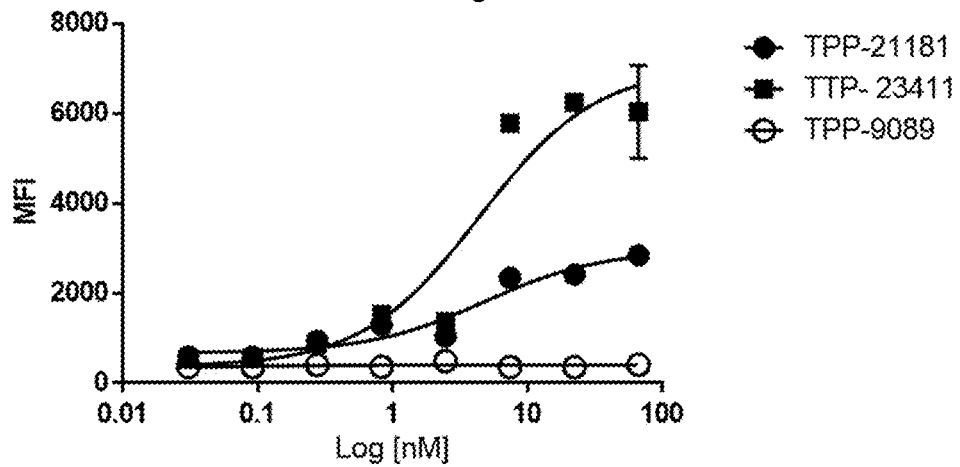

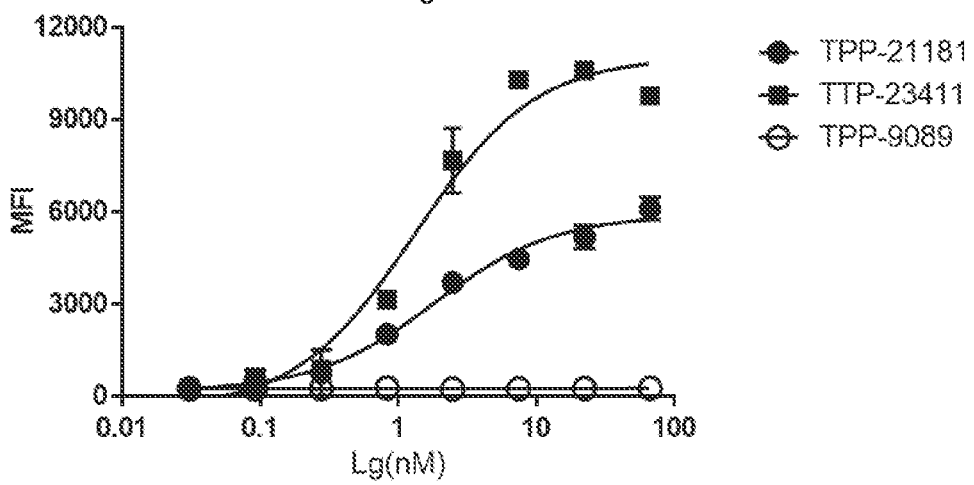
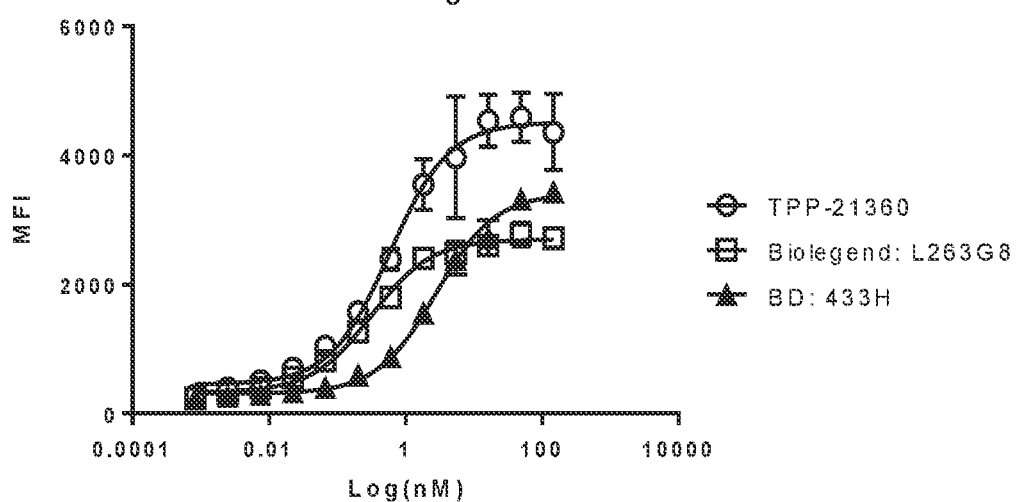
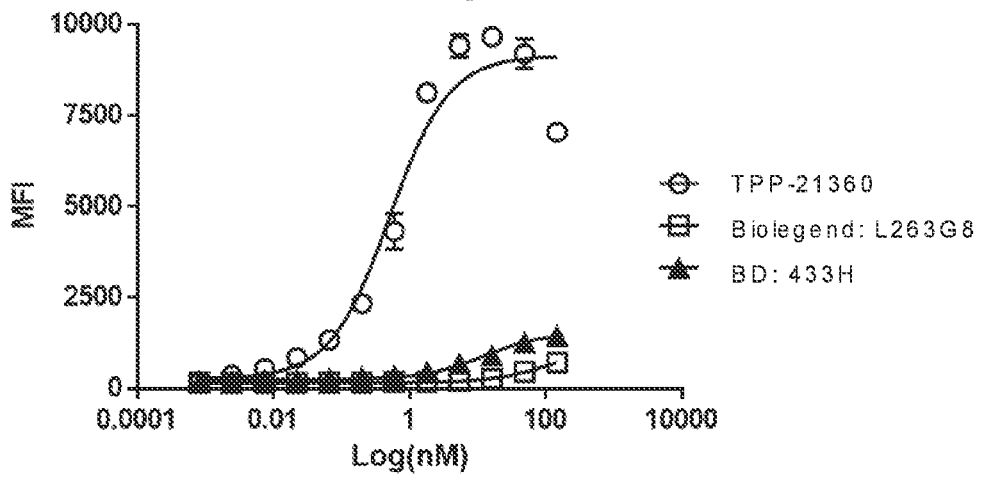

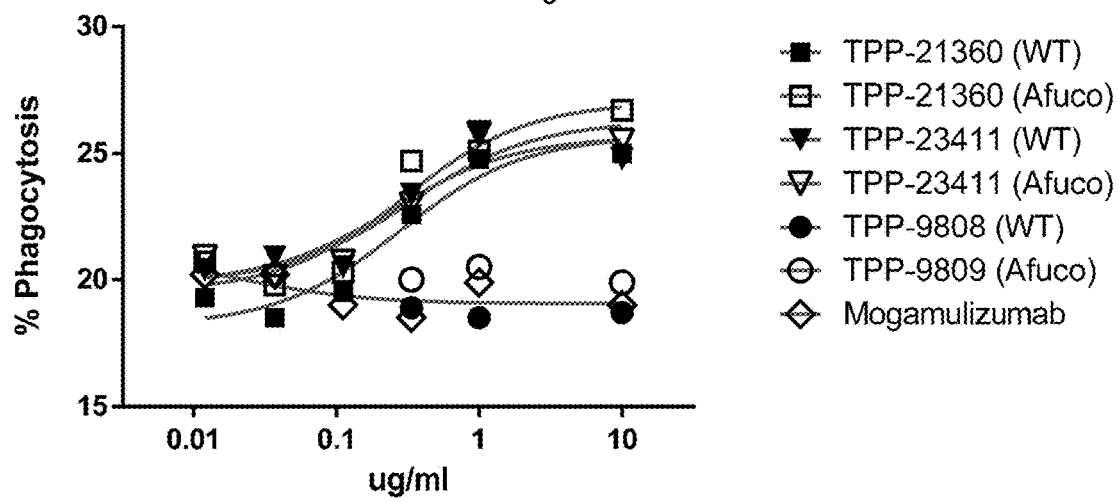
Fig. 23
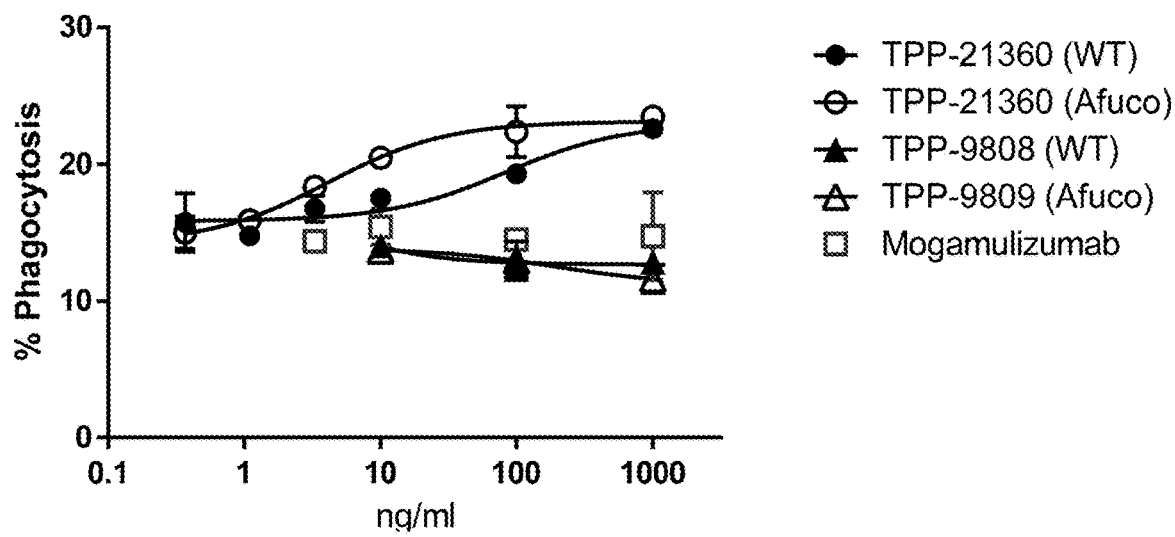
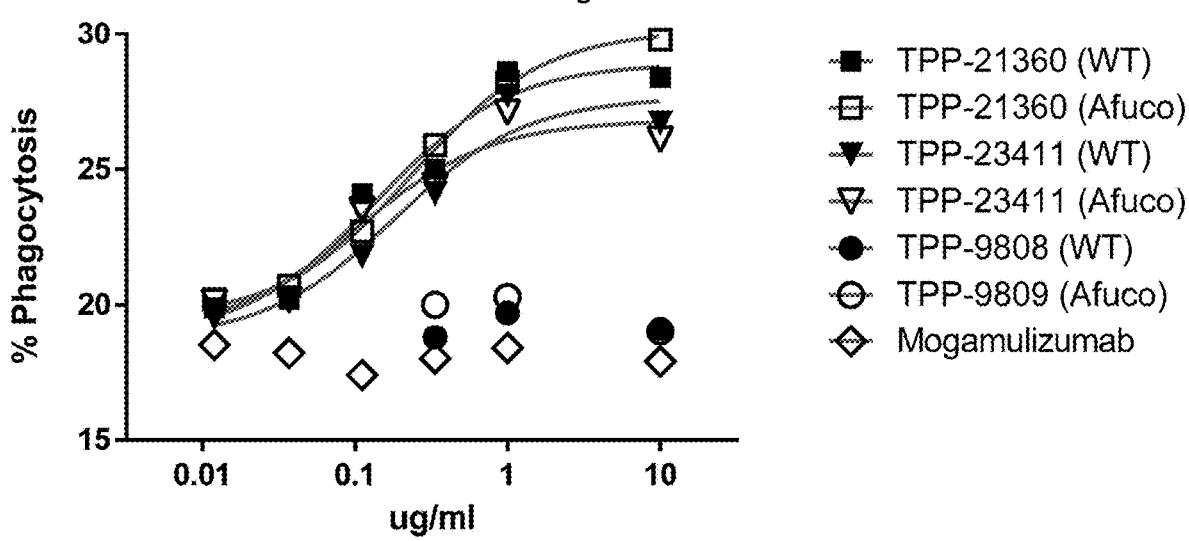
Fig. 24

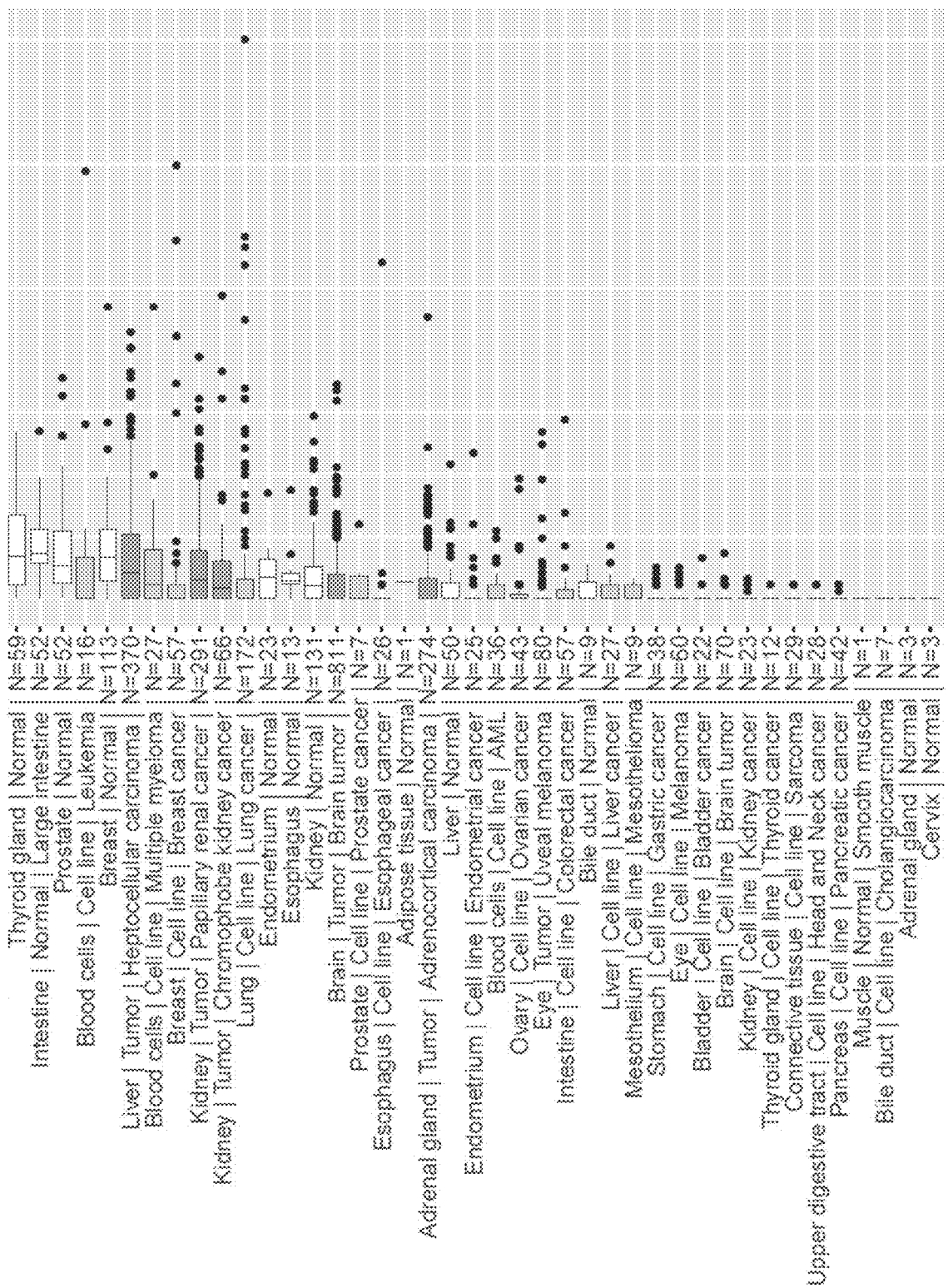

Fig. 37
NSCLC
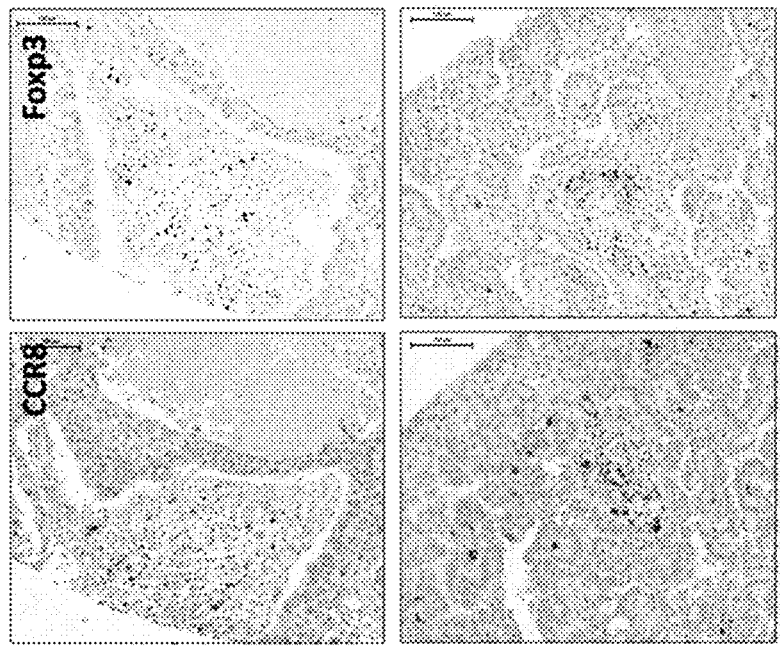
Melanoma
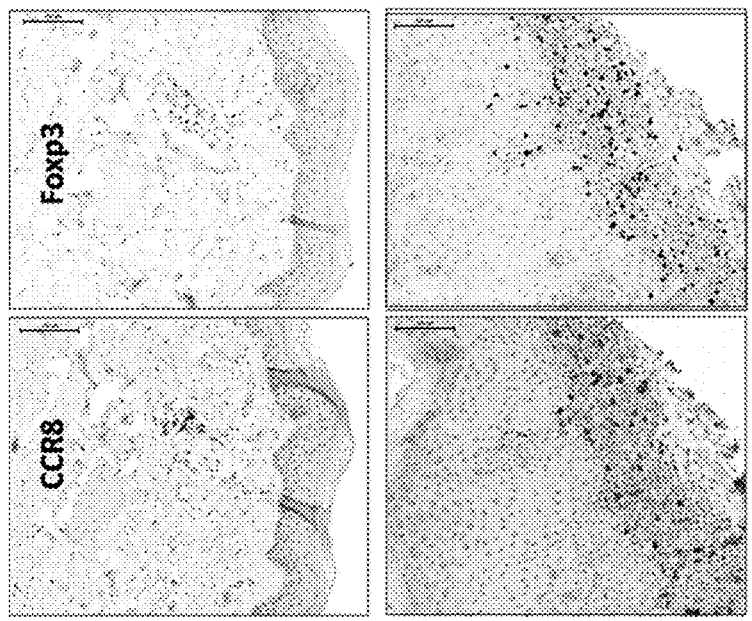

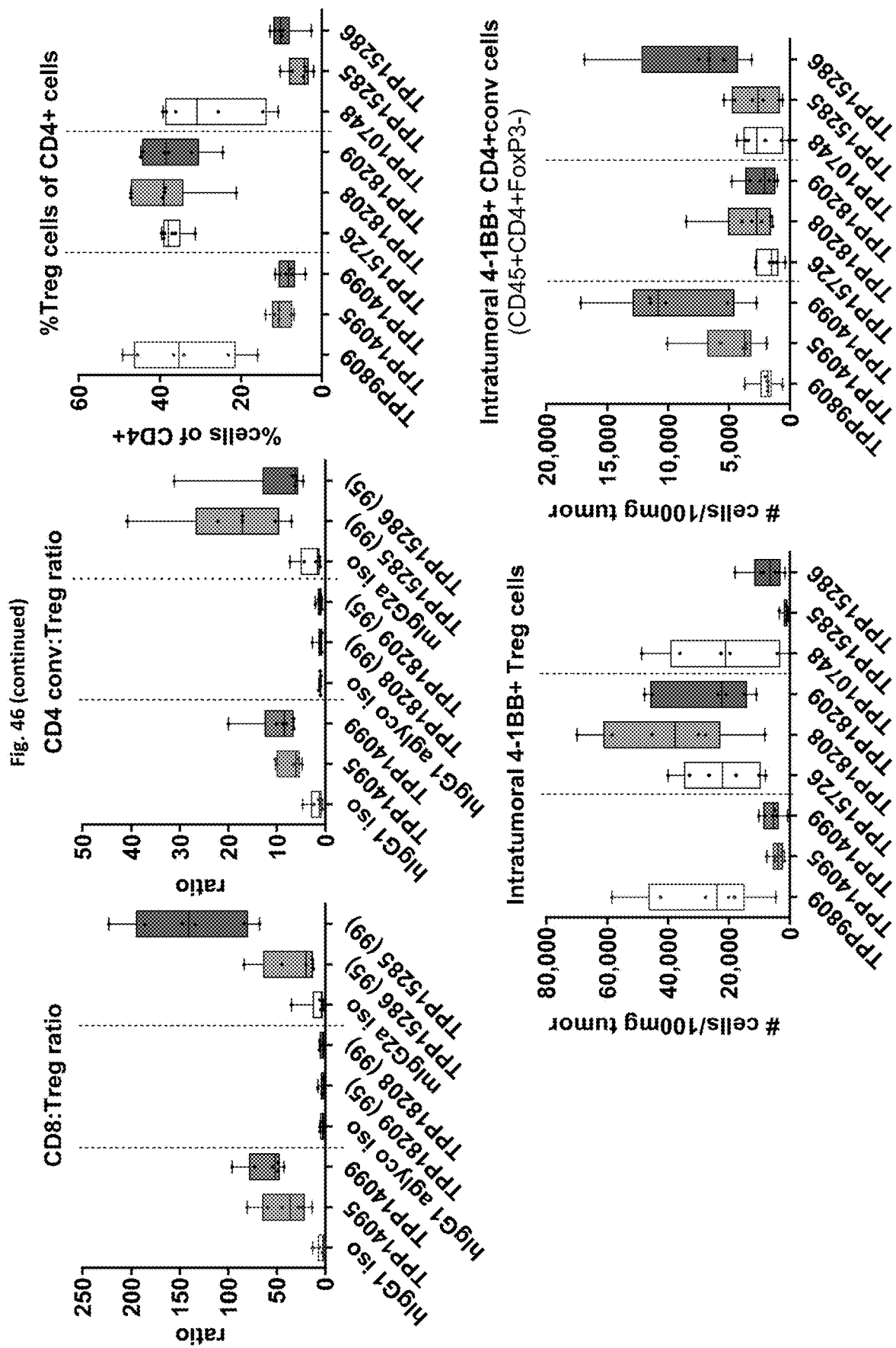

Fig. 58
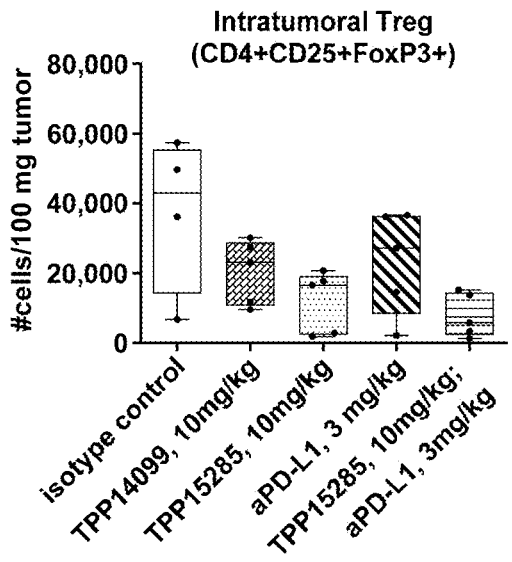
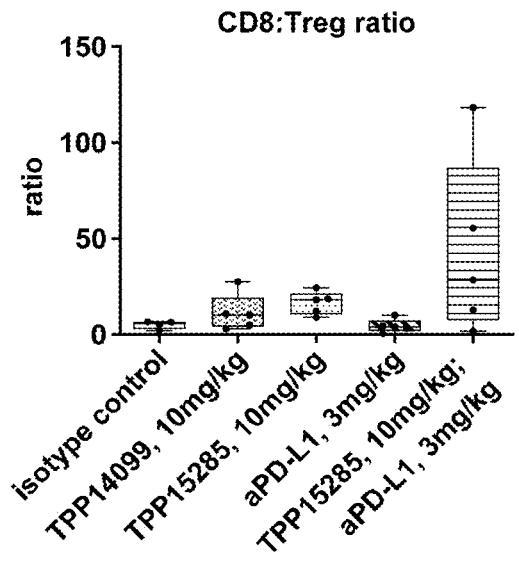
Fig. 59
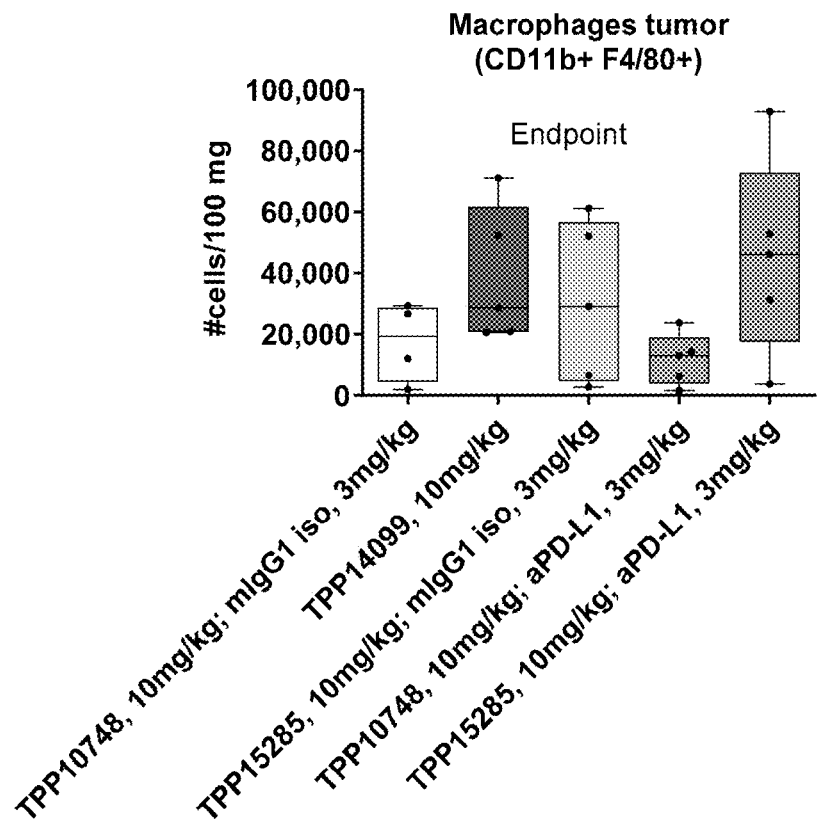

CD8:Treg ratio

C38

H22 growth versus Cd8a expression

CCR8 ANTIBODIES FOR THERAPEUTIC APPLICATIONS

SEQUENCE LISTING SUBMISSION

The Sequence Listing associated with this application is filed in electronic format via EFS-Web and hereby incorporated by reference into the specification in its entirety. The name of the text file containing the Sequence Listing is 172086_00185_ST25. The size of the text file is 763,277 bytes, and the text file was created on Feb. 4, 2022.

TECHNICAL FIELD

The present invention relates to tools and methods for the generation of antibodies which specifically bind chemokine receptors, such as CC or CXC chemokine receptors. Provided are isolated sulfated polypeptides and conjugates thereof, which can be used for example as antigens or for off target panning to facilitate the generation of anti-human, anti-cynomolgus, and/or anti-mouse chemokine receptor antibodies, e.g. for the generation of antibodies with fully human CDRs and/or other favorable properties for therapeutic use.

The present invention furthermore relates to antibodies and conjugates thereof which can be obtained by applying the aforementioned tools and methods. Provided are antibodies specifically binding to human, cynomolgus and/or murine CCR8 with favorable properties for therapeutic use, such as cross-reactive antibodies, fully human antibodies, low internalizing (including non-internalizing) antibodies, and antibodies efficiently inducing ADCC and/or ADCP in Treg cells.

Also provided are medical uses of the inventive antibodies or conjugates and/or treatment methods comprising the administration of these antibodies to a patient or subject, either alone or in combination. Biomarkers, stratification methods and diagnostic methods are finally provided to predict or evaluate responsiveness to anti-CCR8 antibody monotherapy or combination therapy.

The invention furthermore provides tools and methods for producing the foregoing antibodies, pharmaceutical compositions, diagnostic uses of the antibodies, and kits with instructions for use.

Technical Problem

Antibody Generation for CC and CXC Chemokine Receptors

CXC and CC chemokine-receptors are specific seven-transmembrane G-protein-coupled receptors that mediate cell migration in chemotactic gradients. Chemokine receptors are a challenging target class for antibody generation due to their inherent structural, biophysical and biological properties. There are multiple reasons for the difficulties to obtain optimal antibodies against chemokine receptors which shall be discussed in an exemplary fashion, with an emphasis on human CCR8.

Chemokine receptors are characterized by seven domains embedded in the cell membrane and therefore cannot be easily purified in their native confirmation. A purified, native chemokine receptor will have been removed from the membrane environment and is therefore likely to be conformationally compromised. These corrupted structures are typically not suitable for antibody generation, because antibodies are required to recognize the intact antigen as it is presented at the cell surface. Although some chemokine receptors, such as CXCR4 and CCR5, possess some inherent stability that allows for purification in mild detergents, this does not apply to most chemokine receptors (Hutchings, Catherine J., et al. "Opportunities for therapeutic antibodies directed at G-protein-coupled receptors." Nature reviews Drug discovery 16.11 (2017): 787.). This is emphasized by the fact that until today, no X-ray crystal structure is available for CCR8 in the Protein Data Bank PDB (rcsb.org).

In consequence, solubilization for obtaining the required amounts of protein in the native conformation as well as correct orientation and folding for use as immunogen is difficult for chemokine receptors (cf. Klarenbeek, Alex, et al. "Targeting chemokines and chemokine receptors with antibodies." Drug Discovery Today: Technologies 9.4 (2012): e237-e244.).

A schematic representation of the overall structure of human CCR8 is shown in FIG. 2B. Of the 355 amino acids, residues 1-35 (N term), 94-107 (ECL1), 172-202 (ECL2) and 264-280 (ECL3) have been predicted as extracellular domains (uniprot.org). These extracellular domains are assumed to adopt a tertiary structure, stabilized by disulfide bonds. On average, less than 30% of a chemokine receptor is thus exposed at the cell surface. In consequence, chemokine receptors and particularly CCR8 are not easily accessible for antibody binding, as described also in WO200744756.

Furthermore, antibodies generated against peptides corresponding to extracellular domains of chemokine receptors often fail to recognize the intact receptor on the cell, possibly due to differences in secondary structure. In consequence, researchers in this field have had a low success rate in developing antibodies (Tschammer, Nuska, ed. Chemokines: chemokines and their receptors in drug discovery. Vol. 14. Springer, 2015, Chapter by J. E. Pease & R. Horuk, section 6, page 12, 2nd para).

Antibody generation to obtain anti-murine CCR8 antibodies seems slightly less difficult and conventional approaches such as the one described by Kremer and Marquez could be reproduced by the inventors (D'Ambrosio, Daniele, and Francesco Sinigaglia. Cell Migration in Inflammation and Immunity. Springer, 2004, Chapter by Kremer and Marquez p. 243-260). Murine and human CCR8 have a sequence identity of ~70%, which is even lower for the extracellular domains, as described in more detail in example 2. Nevertheless, Kremer and Marquez discuss, that production of anti-mouse chemokine-receptor monoclonal antibodies is a demanding challenge and that antibodies against murine chemokine receptors are comparably scarce, despite the time that has passed since their amino acid sequences were first reported.

Therapeutic Antibodies for Ccr8 and Medical Uses Thereof

Despite the difficulties associated with their generation, antibodies targeting CC chemokine receptors have been suggested as promising therapeutic tools in various diseases, e.g. based on mechanistic insights in diseases with involvement of immune cells or in various cancer indications characterized by aberrant expression of chemokine receptors.

In 2004, Curiel et al. could show for CD4+CD25+ FOXP3+ regulatory T cells (Treg cells or Tregs) in 104 individuals affected with ovarian carcinoma, that human tumor Treg cells suppress tumor-specific T cell immunity and contribute to growth of human tumors in vivo (Curiel, Tyler J., et al. "Specific recruitment of regulatory T cells in ovarian carcinoma fosters immune privilege and predicts reduced survival." Nature medicine 10.9 (2004): 942-949.).

Tumor cells and microenvironmental macrophages produce chemokines such as CCL22, which mediates trafficking of Treg cells to the tumor. High level of Tregs in the tumor microenvironment are not only associated with poor prognosis in many cancers, such as ovarian, breast, renal, and pancreatic cancer, but cause the suppression of the immune response against these cancers, e.g. by suppressing the action of the effector cells of the immune system. This specific recruitment of Treg cells thus represents a mechanism by which tumors may foster immune privilege. It has therefore been suggested to block Treg cell migration or function to defeat human cancer.

Being aware of the finding of Curiel, two independent teams around Plitas/Rudensky and De Simone/Abrignani/Pagani found that tumor infiltrating Treg cells are characterized by selective expression of CCR8. Indeed, selectivity of Treg cell depletion for the tumor infiltrating Tregs is important because systemic depletion of Treg cells may cause severe autoimmunity (Nishikawa, Hiroyoshi, and Shimon Sakaguchi. "Regulatory T cells in tumor immunity." International journal of cancer 127.4 (2010): 759-767.). The search for a specific Treg marker is complicated by the fact, that Treg cells show a molecular pattern which resembles effector lymphocytes, cf. example 11.2. Both peripheral Tregs and tumor-specific effector cells should not suffer from friendly fire during depletion of intra-tumoral Tregs, because peripheral Tregs are important to avoid autoimmunity while tumor-specific effector cells assist in keeping the tumor under control.

Based on these findings various teams have suggested to use CCR8 antibodies for selective depletion of tumor-infiltrating regulatory T cells. While some have presented data confirming tumor reduction in tumor models using anti-human CCR4 or anti-murine CCR8 antibodies, thereby confirming the mechanistic concept of Treg depletion, there is a need for therapeutic anti-human CCR8 antibodies, e.g. with superior properties in therapeutic applications.

PRIOR ART 1.1 Antigens, Methods & Antibodies

The selection of an antigen in antibody generation is crucial for the properties of the resulting antibodies and may pose serious problems as discussed elsewhere herein for chemokine receptors such as CCR8. In some cases, antibodies have been obtained using whole cells as antigens, which were engineered for overexpression of chemokine receptors. At least for some chemokine receptors, these approaches seem to suffer from low numbers of resulting binders. Furthermore, antibodies obtained with these antigens are often characterized by off-target binding and low specificity for the chemokine receptor. If whole cells are used as antigens, immunodominant epitopes can mask other less antigenic ones, where the less antigenic would otherwise have the potential of generating the desired selective and specific antibodies. For CCR8, a successful "whole cell" approach has been described in WO2007044756 (ICOS). In brief, anti-CCR8 monoclonal antibodies were developed by immunizing Balb/c mice with irradiated cells transfected with CCR8 which had high levels of CCR8 expressed on the cell surface. Spleen cells from these mice were fused by standard methods to create hybridomas producing the antibodies. Positive pools were identified by FACS and were cloned by limiting dilution. Two of the antibodies, 433H and 459M, showed a specific reactivity to human CCR8 in immunohistochemistry. Antibody 433H is still available and can be purchased from BD.

Biolegend distributes clone L263G8, a purified mouse IgG2a anti-human CCR8 antibody which has been generated using human CCR8 transfectants as immunogen.

Kremer and Marquez have described the generation of monoclonal antibodies against murine CCR8 (D'Ambrosio, Daniele, and Francesco Sinigaglia. Cell Migration in Inflammation and Immunity. Springer, 2004, Chapter by Kremer and Márquez p. 243-260). In brief, Kremer and Marquez describe the use of peptides derived from the extracellular domains of murine CCR8 as immunogens, but do not suggest sulfation of the tyrosines. Indeed, the inventors found that the approach described by Kremer and Marquez can be successfully applied for antibodies recognizing murine CCR8 but has low success rates for antibodies recognizing human CCR8.

Schaerli et al. have generated anti-human CCR8 antibodies by immunizing rabbits with a human CCR8 peptide conjugate, corresponding to positions 1-34 of the N-terminal region of CCR8 coupled to either KLH or BSA, but again, do not suggest sulfation of the tyrosines (Schaerli, Patrick, et al. "A skin-selective homing mechanism for human immune surveillance T cells." The Journal of experimental medicine 199.9 (2004): 1265-1275.).

A murine monoclonal antibody binding to a 26-amino acid-containing peptide from the extracellular N-terminal portion of CCR8 has been described by Hague et al. (Hague, Nasreen S., et al. "The chemokine receptor CCR8 mediates human endothelial cell chemotaxis induced by 1-309 and Kaposi sarcoma herpesvirus-encoded vMIP-I and by lipoprotein (a)-stimulated endothelial cell conditioned medium." Blood, The Journal of the American Society of Hematology 97.1 (2001): 39-45.).

None of these methods for antibody generation uses an isolated sulfated polypeptide comprising the tyrosine rich domain (TRD) of a chemokine receptor or transmembrane protein as antigen. Use of an isolated sulfated polypeptide comprising the TRD of a chemokine receptor or transmembrane protein as antigen influences both, structural and functional features of the set of obtained antibodies, as discussed elsewhere herein.

In consequence, the antibodies according to the current invention are assumed to deviate in structure and function from the aforementioned prior art antibodies, e.g. at least in their affinity for sulfated CCR8, in their affinity for unsulfated CCR8, in their way and degree of modulating receptor signaling, in their internalization behavior, in cross reactivity, in clearance and pharmacokinetic behavior and finally in Treg depletion and/or efficacy for therapeutic applications.

Furthermore, the use of the antigens disclosed herein enabled the generation of fully human antibodies. In contrast, the discussed prior art antibodies for CCR8 are of non-human origin and deviate from some of the inventive antibodies at least because they do not comprise human CDRs.

1.2 Medical Uses and Mode of Action

Cancer immunotherapy involves the use of a subject's immune system to treat or prevent cancer. Immunotherapies typically exploit the fact that cancer cells often have subtly different molecules on their surface that can be detected by the immune system, the cancer antigens. Immunotherapy thus involves provocation of the immune system into attacking tumor cells via these cancer antigens. However, some cancers, such as solid tumors or hematological cancers can escape immune surveillance. For example, tumor infiltration by regulatory T cells (Treg cells or Tregs) and, more specifically, low ratio of effector T cells (Teff) to Tregs have been proposed as critical factors for hiding the tumor from the immune system (Smyth, Mark J, Shin Foong Ngiow, and Michele W L Teng. "Targeting regulatory T cells in tumor immunotherapy." Immunology and cell biology 92.6 (2014): 473-474.).

Foxp3-expressing regulatory T cells, which are indispensable for preventing autoimmunity, are known to effectively suppress tumor immunity. Treg cells abundantly infiltrate into tumor tissues, which is often associated with poor prognosis in cancer patients. Removal of Treg cells enhances anti-tumor immune responses but may also elicit autoimmunity. A key issue for tailoring Treg-targeting cancer immunotherapy resides in specific depletion of Treg cells infiltrating into tumor tissues without affecting tumor-reactive effector T cells, while suppressing autoimmunity.

Back in 2010 various groups had already investigated that Treg removal, e.g. by depletion with anti-CD25 antibodies, could improve antitumor immunity in mice. It had been shown that depletion of Tregs before the inoculation of tumor cells led to their efficient rejection while Treg depletion occurring simultaneously with or after tumor inoculation resulted in no tumor regression. It had furthermore been suggested, that this was due to the fact, that the administered depleting antibodies also removed CD25-expressing effector T cells, while CD25-Foxp3+ Tregs persisted (Klages, Katjana, et al. "Selective depletion of Foxp3+ regulatory T cells improves effective therapeutic vaccination against established melanoma." Cancer research 70.20 (2010): 7788-7799.).

In 2015, the afucosylated humanized anti-human CCR4 monoclonal antibody mogamulizumab (KW-0761) was evaluated in a clinical study for patients with CCR4-positive cancers (Kurose, Koji, et al. "Phase Ia study of FoxP3+ CD4 Treg depletion by infusion of a humanized anti-CCR4 antibody, KW-0761, in cancer patients." Clinical Cancer Research 21.19 (2015): 4327-4336.). CCR4 is expressed on regulatory T cells. Indeed, mogamulizumab efficiently depleted Treg cells and an augmentation or induction of specific immune responses to cancer antigens was observed. However, mogamulizumab targets both, peripheral as well as intra-tumoral Tregs and further effector cell polulations, thereby leading to immunological side effects such as skin rashes or Stevens Johnson syndrome.

Thus, although the great potential for Treg depletion in cancer therapies was obvious, a concept to selectively target the Tregs and to avoid overt autoimmunity was missing. This was changed with the work of two teams around Plitas/Rudensky and De Simone/Abrignani/Pagani in 2015 and 2016.

Plitas et al. demonstrated that CCR8 is selectively expressed by human breast cancer infiltrating Treg cells and immediately concluded that targeting CCR8 represents a promising immunotherapeutic approach for the treatment of patients with breast cancer and further tumors (Plitas, G., et al. "Abstract P4-04-11: Preferential expression of the chemokine receptor 8 (CCR8) on regulatory T cells (Treg) infiltrating human breast cancers represents a novel immunotherapeutic target." (2016): P4-04; Plitas, George, et al. "Regulatory T cells exhibit distinct features in human breast cancer." Immunity 45.5 (2016): 1122-1134.; U.S. Ser. No. 10/087,259).

Only shortly after publication of the initial work of Plitas et al., De Simone et al. published an analysis on the transcriptional landscape of tumor infiltrating T regulatory cells and found that tumor-infiltrating Treg cells were highly immune suppressive and expressed CCR8 on their cell surface as a specific signature molecule (De Simone, Marco, et al. "Transcriptional landscape of human tissue lymphocytes unveils uniqueness of tumor-infiltrating T regulatory cells." Immunity 45.5 (2016): 1135-1147, WO2017198631). The authors described that CCR8 correlated with poor prognosis and concluded that CCR8 could be an interesting therapeutic target to inhibit Treg cells trafficking to tumor sites, without disturbing recruitment of other effector T cells that do not express CCR8.

WO2018112032 and WO2018112033 describe methods of decreasing the number or activity of tumor infiltrating T regulatory cells (TITR) in a tumor comprising administering an agent that induces cytotoxicity in cells that express a product of a gene, e.g. CCR8.

WO2018112033 and EP3431105 describe a molecule which can modulate the expression and/or function of at least one marker that is selectively deregulated in tumor-infiltrating regulatory T cells for use in the prevention and/or treatment of this tumor.

WO2018181425 relates to an antibody against CCR8 having ADCC activity, for use in a method of treating a cancer, wherein the antibody against CCR8 is a CCR8-neutralizing antibody. WO2018181425 does not disclose specific antibody sequences but refers to rat anti-mouse CCR8 clone SA214G2 distributed by BioLegend under Cat. No. 150302. This antibody was used as a tool antibody to recapitulate the previously described anti-tumorigenic effects of Treg depletion in mice.

According to the current invention, a method is provided which facilitates the generation of anti-CCR8 antibodies and yields antibodies having superior properties for therapeutic uses. The antibodies according to the current invention were compared with the prior art antibodies and were found to deviate in structure, function and therapeutic efficacy, as discussed elsewhere herein.

Solution to Problem 1.1 Antibody Generation for CC and CXC Chemokine Receptors

Because prior art approaches to generate antibodies for CC chemokine receptors suffer from low success rates, and resulting antibodies often show a poor performance (cf. e.g. example 3), the inventors developed a novel method to generate antibodies for chemokine receptors in general and, in particular, to generate anti-CCR8 antibodies.

The use of a specifically modified isolated polypeptide as antigen for the selection of human anti-human CCR8 antibodies solved the problem to provide an improved method for antibody generation against CC and CXC chemokine receptors, such that e.g. fully human anti-CCR8 antibodies could be obtained for the first time, cf. example 6. In more detail, a polypeptide comprising the tyrosine rich domain of human CCR8, optionally including the LID domain, was modified by introduction of sulfate modifications at specific positions in order to form the antigen, cf. example 4, Table 4.1. A phage display approach was optionally used together with this specifically modified antigen to select fully human anti-human CCR8 antibodies. In the alternative, the sulfated antigens can be used in various further methods, e.g. in conventional immunization approaches.

The obtained antibodies showed an excellent binding profile for the sulfated antigen and the biological target expressed under physiological conditions, cf. examples 6, 10.1.1, but a comparably low or no affinity for the unmodified antigen, cf example 10.1.2, example 10.1.3, demonstrating that the sulfated residues were indeed crucial for antigen antibody binding. The inventive antibodies furthermore showed an excellent and also specific binding on cell lines engineered to express human, cynomolgus or murine CCR8, and also on activated human Tregs, cf. example 10.1.1.

Out of the six CDR loops of an antibody, the H3 loop shows the greatest structural diversity and is located in the center of the binding site. It also gains the most mutations through affinity maturation and has on average the largest number of contacts with the antigen. It therefore plays a crucial role in antigen binding. Upon analysis of the specific structure of the antibodies obtained with the method according to the current invention, it was surprisingly found that the composition of the HCDR3 was structurally different from usual human HCDR3 domains, cf. example 9. In particular, the HCDR3 domains of the antibodies with the therapeutically most beneficial properties and specific binding to CCR8 were characterized by an average frequency of ~21% tyrosine residues and an average histidine content of ~10%, emphasizing a beneficial impact of these residues on the recognition of the specific sulfated antigen (cf. Table 9.2). Without being bound by theory, the inventors believe that these structural features translate into certain functional characteristics which make the obtained antibodies more suitable for therapeutic applications. For example, and in contrast to the tested prior art antibodies, several antibodies according to the invention block G protein dependent signaling, cf. example 10.4.3, but do not impact G protein independent pathways, cf. examples 10.4, 10.4.1, 10.4.2, and do not substantially internalize into cells with endogenous expression of the target chemokine receptor, cf. example 10.5. In addition, particularly preferred antibodies according to the current invention were specific for the target receptor and target cells, cf. example 10.2, 11, and are especially suitable/showed superior properties in methods of treatment for cancer, cf. examples 12 ff. Furthermore, use of these synthetic polypeptides either as antigens or for off target panning facilitated or enabled the generation of cross-reactive antibodies, such as antibodies specifically binding to human CCR8 and/or cynomolgus CCR8, cf. example 10.1.1.

1.2 Provision of Therapeutic Antibodies Specifically Binding Chemokine Receptors

1.2.1 Obtaining Chemokine Receptor Antibodies with Human CDRs

While humanization of antibodies with murine CDRs may improve the immunogenicity of an antibody, residual immunogenicity resides in the CDR regions (Harding, Fiona A., et al. "The immunogenicity of humanized and fully human antibodies: residual immunogenicity resides in the CDR regions." MAbs. Vol. 2. No. 3. Taylor & Francis, 2010.). Antibodies comprising human CDRs are thus assumed to have a superior suitability as therapeutic agents for humans compared with antibodies comprising CDRs from other species.

For example, antibodies with human CDRs can be produced via phage display technologies or using transgenic animals capable of generating fully human antibodies. However, it is not always trivial to obtain fully human antibodies. While, in theory, the diversity of HCDR3 regions is almost unlimited, in practice the generation of the antibody repertoire diversity appears to be carefully regulated by multiple mechanisms, which yield an in vivo repertoire that is restricted in its diversity and constrained in its range of antigen-binding sites. This is also the case for human phage display libraries, which are often designed to reflect the in vivo repertoire. Thus, in some cases, the structural requirements of a "complicated" antigen may be fulfilled by rodent CDRs, while the same structure cannot be readily recognized by human CDRs. Based on the observation that tyrosine representation is on average approximately 50% lower in human HCDR3 than in murine HCDR3, it can be assumed that it is clearly more challenging to find a human anti-human antibody in cases, where the unique binding abilities of tyrosine and histidine are required to enable the target binding. Indeed, the inventors are not aware of fully human anti-human CCR8 prior art antibodies. According to the current invention there are provided CCR8 antibodies comprising human derived CDRs, and also fully human antibodies, cf. examples 6, 7, 8.

1.2.2 Obtaining Cross Reactive Chemokine Receptor Antibodies

Cross reactive anti-chemokine receptor antibodies such as cross reactive anti-CCR8 antibodies are advantageous for the development of a therapeutic antibody, because they can be used in non-human animal models to characterize the therapeutic agents with regards to pharmacological data and safety, before the antibodies are administered to humans. However, cross reactive antibodies e.g. with similar binding behavior in two species are difficult to generate and cannot be easily affinity maturated, e.g. because the extracellular parts of chemokine receptors such as CCR8 have a low homology between species (see example 2). According to the current invention, cross reactive antibodies for CCR8 can be generated in particular by using small sulfated tyrosine comprising motifs which have a higher conservation between species, such that cross reactive antibodies binding a chemokine receptor such as CCR8 from two or more species, e.g. with affinities in the same order of magnitude can be obtained in an easy and convenient way, cf. examples 6, 7, 10.1.1.

1.2.3 Obtaining Chemokine Receptor Antibodies for Therapy

To induce the killing of cells expressing a target chemokine receptor or CCR8, multiple modes of action can be envisioned. One mode of action is the conjugation of an antibody targeting the chemokine receptor or CCR8 to a drug in the form of an antibody drug conjugate (ADC). Other possible modes of action are induction of antibody-dependent cellular cytotoxicity (ADCC), antibody-dependent cellular phagocytosis (ADCP) and/or complement-dependent cytotoxicity (CDC). For ADCC, CDC and ADCP, a two-step mechanism is involved: On the one hand, the antibody or fragment is required to effectively bind the target cell, e.g. the Treg via CCR8, on the other hand, the FC part of the antibody (or an alternative binding moiety which can be conjugated to the antibody or fragment as described elsewhere herein) has to bind to an effector cell, which will then mediate the killing of the target cell. For ADCP, binding to macrophages as effector cells typically occurs via the interaction of the antibodies FC part with FcγRIIa (CD32a) expressed by macrophages. In contrast, ADCC is mediated via interaction of the antibody or fragment with FcγRIIIa. In humans, FcγRIII exists in two different forms: FcγRIIIa (CD16a) and FcγRIIIb (CD16b). While FcγRIIIa is expressed on mast cells, macrophages, and natural killer cells as a transmembrane receptor, FcγRIIIb is only expressed on neutrophils. These receptors bind to the Fc portion of IgG antibodies, which then activates antibody-dependent cell-mediated cytotoxicity (ADCC) mediated by the human effector cells.

1.2.4 Obtaining Low Internalizing (Including Non-Internalizing) Chemokine Receptor Antibodies When the inventors analyzed known anti-human CCR8 prior art antibodies, they found that these antibodies readily internalized into a cell with endogenous target expression but did not reside on the cell surface for extended periods of time. The internalization behavior of an antibody does not only influence its clearance and pharmacological behavior but also its suitability for a specific mode of action for therapeutic uses.

While high internalization is desirable for the generation of certain antibody drug conjugates, it is undesirable for ADCC induced depletion of tumor cells or Treg cells. In more detail, an antibody drug conjugate is required to transport the drug into the cell to achieve an efficient and specific depletion of the target cell. In contrast, the ADCC mode of action requires the exposure of the antibody and its Fc domain at the outside of the target cell, where the immune effector cells can bind the FC domain for the lysis of the target cell. A low or even absent internalization rate thereby increases the time of effect for an ADCC/ADCP inducing antibody.

Upon characterization of the antibodies obtained with the novel method, the inventors surprisingly found, that several of the antibodies according to the current invention showed a particularly low or even absent internalization profile in cells with endogenous expression levels of CCR8, cf. example 10.5, while the prior art antibodies recognizing the same target had a higher internalization rate. For example, prior art antibodies 433H and L263G8 readily internalized into the targeted cell and did not reside on the cell surface for extended periods of time. Due to their low internalization properties, some of the antibodies according to the current invention are thus particularly useful in an ADCC, ADCP, CDC or a mixed approach, such as a combined ADCC/ADCP approach.

Typically, the selection of a target is an important factor which strongly influences the internalization of an antibody into a cell. According to Islam S A et al, CCL1 ligand binding induces Ca2+ flux and rapid receptor internalization of CCR8 (Islam, Sabina A., et al. "Identification of human CCR8 as a CCL18 receptor CCR8 is a CCL18 receptor." The Journal of experimental medicine 210.10 (2013): 1889-1898.). The inventors found it surprising that the antibody itself was able to influence the internalization properties in such a substantial degree. However, when they characterized the ability of the inventive antibodies to modulate G protein independent signaling pathways of their target chemokine receptor, they found that all tested prior art antibodies not only blocked G protein dependent signaling, but also modulated G protein independent signaling, cf. examples 10.4 ff. G protein independent signaling has been previously linked to internalization behavior, cf. Fox, James M., et al. "Structure/function relationships of CCR8 agonists and antagonists: Amino-terminal extension of CCL1 by a single amino acid generates a partial agonist." Journal of Biological Chemistry 281.48 (2006): 36652-36661.

1.2.5 Obtaining Chemokine Receptor Antibodies Modulating Target Receptor Signaling There are multiple different ways how an antibody can modulate a chemokine receptor. For example, an antibody can
a) block G-protein independent signaling,
b) block G-protein dependent signaling,
c) block G-protein dependent and G-protein independent signaling,
d) increase G-protein independent signaling,
e) increase G-protein dependent signaling,
f) increase G-protein dependent and G-protein independent signaling.

Without being bound by theory, the inventors hypothesize that the sulfated TRD of the respective chemokine receptor may be relevant for the ligand induced signaling of the chemokine receptor. Interestingly, most of the inventive antibodies efficiently blocked ligand induced G-protein dependent signaling but did not influence G protein independent signaling, cf. examples 10.4 ff. In contrast, all prior art antibodies likewise blocked ligand induced G-protein dependent signaling but agonized G-protein independent signaling. Without being bound by theory, these differences may contribute to the differences in internalization behavior.

Avoiding induction of G protein independent signaling by a therapeutic antibody might also be advantageous, because unspecific signaling may result in uncontrollable downstream effects such as an increased cell proliferation, cf. Hutchings, Catherine J., et al. (2017); Webb, David R., et al. "Opportunities for functional selectivity in GPCR antibodies." Biochemical pharmacology 85.2 (2013): 147-152.; Fox, James M., et al. (2006).

1.2.6 Obtaining ADCC/ADCP Inducing Chemokine Receptor Antibodies

The antibodies according to the current invention are characterized by a superior induction of ADCC and ADCP, as shown e.g. in example 10.3.3, 10.3.4. In some preferred embodiments, the antibodies were engineered by elimination of the fucose at N297 (afucosylation) to obtain the high ADCC rates, cf. examples 10.3.1. Interestingly, many of the inventive anti-CCR8 antibodies seemed to induce target cell depletion via a combined mode of action using both mechanisms, i.e. ADCC and ADCP.

1.3 Methods for Treatment

While it has been suggested by several research groups to use antibodies binding CCR8 in methods of treatment based on mechanistic insights, the way to the provision of antibodies with optimal therapeutic properties has been tedious. By providing a method for antibody generation according to the current invention, antibodies for chemokine receptors with superior therapeutic properties can now be easily obtained. According to the current invention, various sequence defined antibodies with favorable properties are disclosed, which can be used in a method of treatment, e.g. as part of a conjugate, in an ADCC based approach, in an ADCP based approach, in a CDC based approach, or in a mixed ADCC/ADCP based approach. Examples 12 ff. show remarkable efficacies in Treg depletion, Overall Response Rate and Tumor-to-Control ratio for surrogate antibodies generated with a method according to the current invention.

1.4 Combination Treatment

While remarkable response rates were obtained in monotherapy with the inventive anti-CCR8 antibodies, it was surprisingly found that the therapeutic benefit could be further increased by combining the antibodies with immune checkpoint inhibitors, with further targeted therapies, and even with unspecific chemotherapeutics or radiation therapy. These combination treatments were particularly beneficial in challenging tumor models. In particular, a specific combination treatment scheme was found effective, where the second therapeutic agent or therapy was administered only after the anti-CCR8 antibody had caused substantial Treg depletion (see examples 12.6 ff.). Furthermore, it was observed that even a single anti-CCR8 antibody treatment showed a substantial therapeutic effect (see example 12.4.2).

1.5 Stratification Schemes and Diagnostic Methods

When evaluating the responsiveness of different syngeneic mouse models to anti-CCR8 antibody treatment, the inventors could identify several mechanisms, biomarkers and biomarker combinations that were predictive for treatment efficacy and overall response. For example, it was surprisingly found that the degree of responsiveness to immune checkpoint inhibitors such as PD-1, PD-L1 or CTLA4 antibodies was also predictive for the response to anti-CCR8 antibody treatment. Because PD-L1 expression is sometimes used as a surrogate marker to predict the responsiveness for immune checkpoint inhibitors, the inventors evaluated if PD-L1 could also be used to predict the responsiveness for anti-CCR8 antibody treatment. This hypothesis could finally be confirmed by correlation data, see example 12.7.1. In a further attempt to identify those subjects that would most likely benefit from anti-CCR8 treatment, further marker genes, such as immune cell and Treg markers were evaluated as biomarkers (see examples 12.1.2, 12.7.2, 12.8).

BRIEF DESCRIPTION OF THE DRAWINGS

Figure 1:
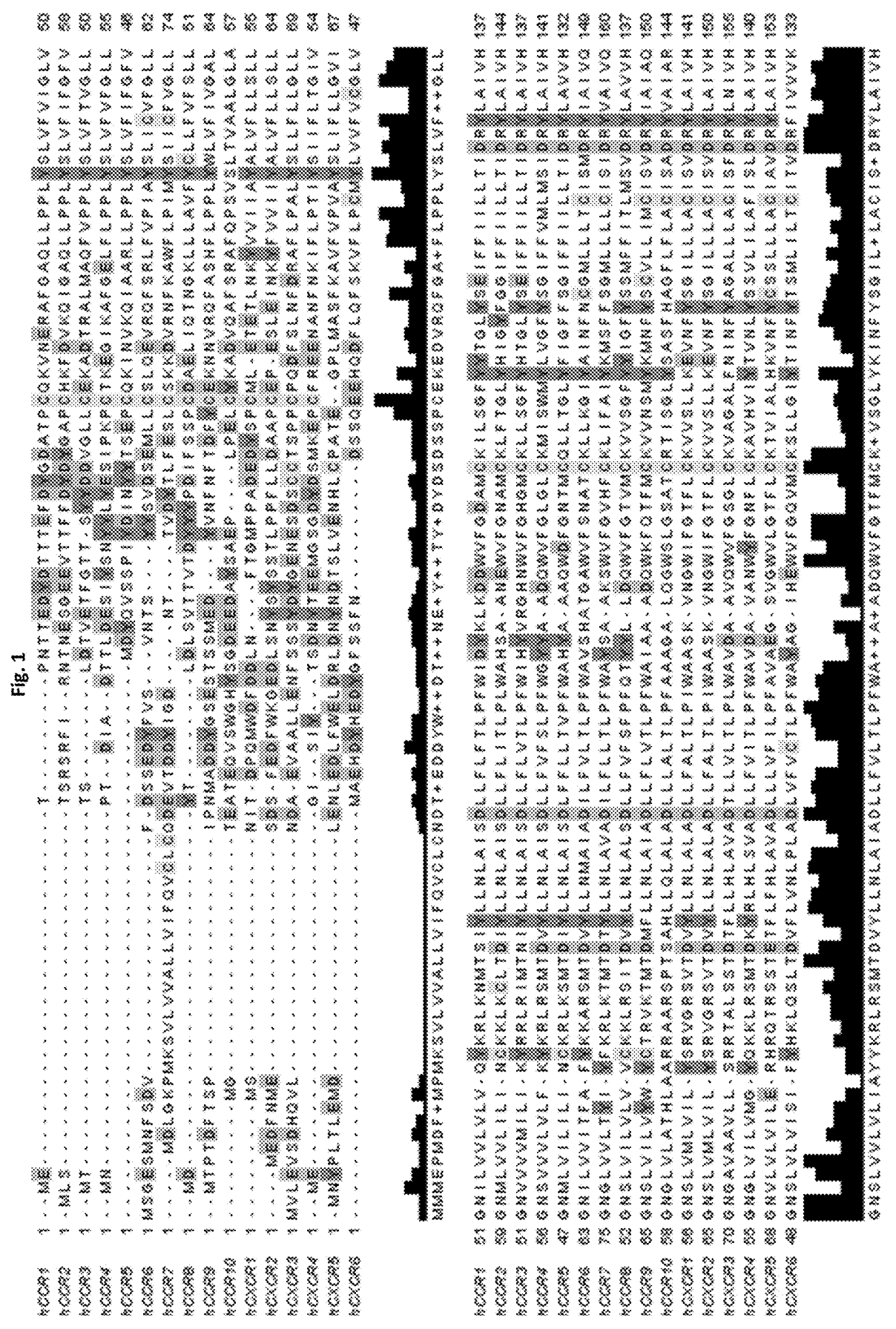
Figure 1:
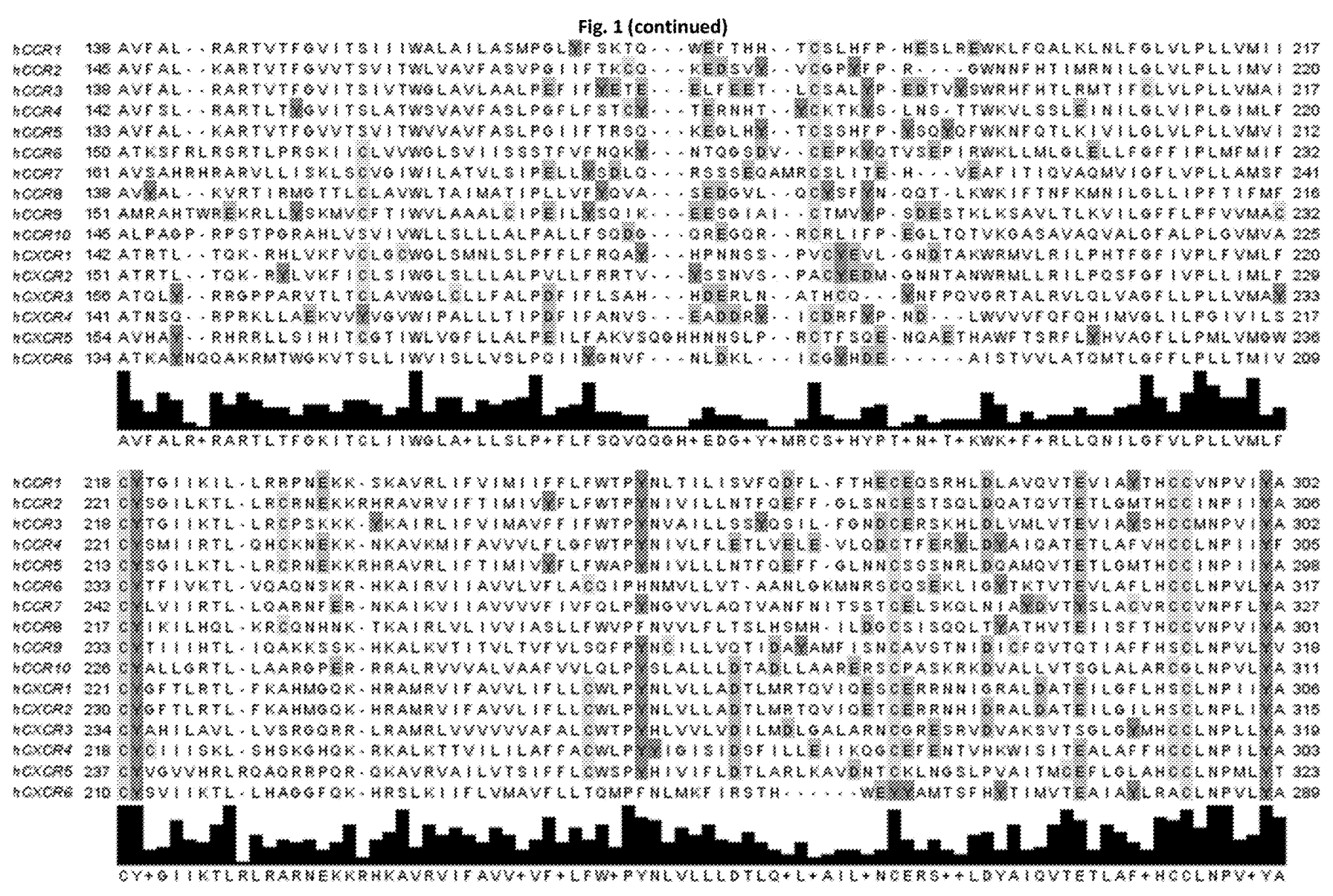

FIG. 1: Alignment of human CC chemokine receptors and CXC chemokine receptors. The following sequences are shown, ordered from top to bottom: hCCR1 (SEQ ID NO:109), hCCR2 (SEQ ID NO:112), hCCR3 (SEQ ID NO:115), hCCR4 (SEQ ID NO:118), hCCR5 (SEQ ID NO:121), hCCR6 (SEQ ID NO:124), hCCR7 (SEQ ID NO:127), hCCR8 (SEQ ID NO:130), hCCR9 (SEQ ID NO:133), hCCR10 (SEQ ID NO: 136), hCXCR1 (SEQ ID NO:139), hCXCR2 (SEQ ID NO:142), hCXCR3 (SEQ ID NO:145), hCXCR4 (SEQ ID NO:148), hCXCR5 (SEQ ID NO:151), and hCXCR6 (SEQ ID NO:154).

FIG. 2A: Human CCR8 (SEQ ID NO:130), cynomolgus CCR8 (SEQ ID NO:131), and murine CCR8 (SEQ ID NO:132) sequences were retrieved from Uniprot and aligned with Clustal Omega.

FIG. 7: FACS data of inventive antibodies binding to CHO cells expressing cynomolgus CCR8.

FIG. 8: FACS data of candidates binding to activated human Tregs (donor 1). Right side: Percent of CCR8 expression determined using BioLegend Clone L263G8.

FIG. 9: FACS data of inventive antibodies TPP-21181 and TPP-23411 binding to CHO cells expressing human CCR8.

FIG. 10: FACS data of inventive antibodies TPP-21181 and TPP-23411 binding to CHO cells expressing cynomolgus CCR8.

FIG. 11: Binding of TPP-21360, L263G8, and 433H to CHO cells expressing human CCR8.

FIG. 12: Binding of TPP-21360, L263G8, and 433H to CHO cells expressing cynomolgus CCR8. Prior art antibodies showed only very low overall binding to cynomolgus CCR8 (low saturation). Nevertheless, EC50 values could be determined for each antibody.

FIG. 23: ADCP assay for wild type and afucosylated versions of inventive antibodies TPP-21360, and TPP-23411 shows induction of phagocytosis in activated human Tregs from two different donors as target cells (upper or lower panel) and M2c macrophages as effector cells. TPP-9808 is the isotype control.

FIG. 24: ADCP assay for wild type and afucosylated versions of inventive antibodies TPP-21360, and TPP-23411 shows induction of phagocytosis in activated human Tregs as target cells and M1 macrophages as effector cells.

FIG. 37: Immunohistochemistry with staining of Treg markers FOXP3 and CCR8 (clone 433H) in human Non-small-cell lung cancer tissue (NSCLC) or human melanoma tissue.

FIG. 58: Analysis of tumoral Treg depletion in C38 tumors by flow cytometry (sampling 24 hours after second antibody treatment). C38 tumor bearing mice were treated with anti-CCR8 surrogate antibodies TPP-14099 or TPP-15285 or anti-PD-L1 antibody in monotherapy, or with TPP-15285 in combination with anti-PD-L1 antibody. Absolute Treg depletion. CD8+ T cell/Treg cell ratios.

FIG. 59: CD11+F4/80+ macrophages in C38 tumors as analyzed by flow cytometry (sampling at study end).

BRIEF DESCRIPTION OF THE SEQUENCE IDS

Figure 2B:
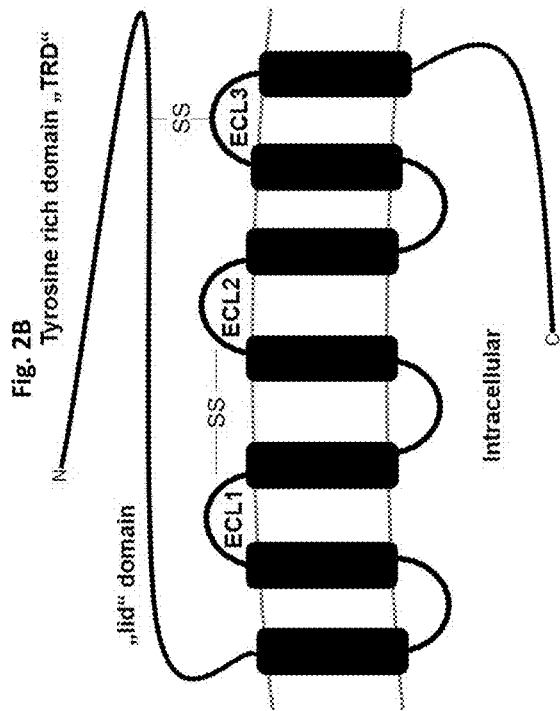
FIG. 2B: Schematic representation of CCR8 receptor structure which contains 7 transmembrane domains (black boxes), three extracellular loops (ECL), several disulfide bridges (SS), and an intracellular C-terminal part as well as the extracellular N-terminal domain composed of the "LID" domain and the tyrosine rich domain (TRD).

The sequence listing provided with the application via electronic filing is included herein in its entirety. SEQ ID NO:1 to SEQ ID NO:108 and SEQ ID NO:157 to SEQ ID NO:168 relate to isolated polypeptides which can be used as antigens or for off target panning. SEQ ID NO:109 to SEQ ID NO:156 relate to chemokine receptor proteins from different species. SEQ ID NO:201 to SEQ ID NO:965 relate to inventive antibodies. The column on sulfations is provided for convenience only and is not intended to restrict the respective sequence in any way.

| Sequence Name | Sequence Region | Type | SEQ ID | Sulfated |
|---|---|---|---|---|
| P32246_CCR1_HUMAN_TRD | ANTIGEN | PRT | SEQ ID NO:1 | Y10,Y18 |
| Q2Y2P0_CCR1_MACFA_TRD | ANTIGEN | PRT | SEQ ID NO:2 | Y10,Y18 |
| P51675_CCR1_MOUSE_TRD | ANTIGEN | PRT | SEQ ID NO:3 | Y10, Y18 |
| P32246_CCR1_HUMAN_N term | ANTIGEN | PRT | SEQ ID NO:4 | Y10,Y18 |
| Q2Y2P0_CCR1_MACFA_N term | ANTIGEN | PRT | SEQ ID NO:5 | Y10,Y18 |
| P51675_CCR1_MOUSE_N term | ANTIGEN | PRT | SEQ ID NO:6 | Y10, Y18 |
| P41597_CCR2_HUMAN_TRD | ANTIGEN | PRT | SEQ ID NO:7 | Y26,Y28 |
| O18793_CCR2_MACMU_TRD | ANTIGEN | PRT | SEQ ID NO:8 | Y26,Y28 |
| P51683_CCR2_MOUSE_TRD | ANTIGEN | PRT | SEQ ID NO:9 | Y37, Y39 |
| P41597_CCR2_HUMAN_N term | ANTIGEN | PRT | SEQ ID NO:10 | Y26,Y28 |

-continued

| Sequence Name | Sequence Region | Type | SEQ ID | Sulfated |
|---|---|---|---|---|
| O18793_CCR2_MACMU_N term | ANTIGEN | PRT | SEQ ID NO:11 | Y26,Y28 |
| P51683_CCR2_MOUSE_N term | ANTIGEN | PRT | SEQ ID NO:12 | Y37, Y39 |
| P51677_CCR3_HUMAN_TRD | ANTIGEN | PRT | SEQ ID NO:13 | Y16, Y17 |
| Q9BDS8_CCR3_MACFA_TRD | ANTIGEN | PRT | SEQ ID NO:14 | Y16 |
| P51678_CCR3_MOUSE_TRD | ANTIGEN | PRT | SEQ ID NO:15 | Y20,Y22 |
| P51677_CCR3_HUMAN_N term | ANTIGEN | PRT | SEQ ID NO:16 | Y16, Y17 |
| Q9BDS8_CCR3_MACFA_N term | ANTIGEN | PRT | SEQ ID NO:17 | Y16 |
| P51678_CCR3_MOUSE_N term | ANTIGEN | PRT | SEQ ID NO:18 | Y20,Y22 |
| P51679_CCR4_HUMAN_TRD | ANTIGEN | PRT | SEQ ID NO:19 | (Y16, Y19, Y20), Y22 |
| G7NYB7_CCR4_MACFA_TRD | ANTIGEN | PRT | SEQ ID NO:20 | (Y16, Y19, Y20), Y22 |
| P51680_CCR4_MOUSE_TRD | ANTIGEN | PRT | SEQ ID NO:21 | (Y16, Y19, Y20), Y22 |
| P51679_CCR4_HUMAN_N term | ANTIGEN | PRT | SEQ ID NO:22 | (Y16, Y19, Y20), Y22 |
| G7NYB7_CCR4_MACFA_N term | ANTIGEN | PRT | SEQ ID NO:23 | (Y16, Y19, Y20), Y22 |
| P51680_CCR4_MOUSE_N term | ANTIGEN | PRT | SEQ ID NO:24 | (Y16, Y19, Y20), Y22 |
| P51681_CCR5_HUMAN_TRD | ANTIGEN | PRT | SEQ ID NO:25 | Y3,Y10,Y14,Y15 |
| P61814_CCR5_MACFA_TRD | ANTIGEN | PRT | SEQ ID NO:26 | Y3,Y10,Y14,Y15 |
| P51682_CCR5_MOUSE_TRD | ANTIGEN | PRT | SEQ ID NO:27 | Y10, Y12, Y16 |
| P51681_CCR5_HUMAN_N term | ANTIGEN | PRT | SEQ ID NO:28 | Y3,Y10,Y14,Y15 |
| P61814_CCR5_MACFA_N term | ANTIGEN | PRT | SEQ ID NO:29 | Y3,Y10,Y14,Y15 |
| P51682_CCR5_MOUSE_N term | ANTIGEN | PRT | SEQ ID NO:30 | Y10, Y12, Y16 |
| P51684_CCR6_HUMAN_TRD | ANTIGEN | PRT | SEQ ID NO:31 | Y18, Y26, Y27 |
| A0A2K5WY45_CCR6_MACFA_TRD | ANTIGEN | PRT | SEQ ID NO:32 | Y23, Y31, Y32 |
| O54689_CCR6_MOUSE_TRD | ANTIGEN | PRT | SEQ ID NO:33 | (Y7), Y13,Y18,Y19 |
| P51684_CCR6_HUMAN_N term | ANTIGEN | PRT | SEQ ID NO:34 | Y18, Y26, Y27 |
| A0A2K5WY45_CCR6_MACFA_N term | ANTIGEN | PRT | SEQ ID NO:35 | Y23, Y31, Y32 |
| O54689_CCR6_MOUSE_N term | ANTIGEN | PRT | SEQ ID NO:36 | (Y7), Y13,Y18,Y19 |
| P32248_CCR7_HUMAN_TRD | ANTIGEN | PRT | SEQ ID NO:37 | Y8, Y17 |
| C0ISS3_CCR7_MACFA_TRD | ANTIGEN | PRT | SEQ ID NO:38 | Y8, Y17 |
| P47774_CCR7_MOUSE_TRD | ANTIGEN | PRT | SEQ ID NO:39 | Y8, Y17, Y20 |
| P32248_CCR7_HUMAN_N term (w/o Signal Peptide) | ANTIGEN | PRT | SEQ ID NO:40 | Y8, Y17 |
| C0ISS3_CCR7_MACFA_N term (w/o Signal Peptide) | ANTIGEN | PRT | SEQ ID NO:41 | Y8, Y17 |
| P47774_CCR7_MOUSE_N term (w/o Signal Peptide) | ANTIGEN | PRT | SEQ ID NO:42 | Y8, Y17, Y20 |
| P51685_CCR8_HUMAN_TRD | ANTIGEN | PRT | SEQ ID NO:43 | Y3, Y15, (16), Y17 |
| G7NYJ2_CCR8_MACFA_TRD | ANTIGEN | PRT | SEQ ID NO:44 | Y3, Y15, (16), Y17 |
| P56484_CCR8_MOUSE_TRD | ANTIGEN | PRT | SEQ ID NO:45 | Y3, Y14, Y15 |
| P51685_CCR8_HUMAN_N term | ANTIGEN | PRT | SEQ ID NO:46 | Y3, Y15, (16), Y17 |
| G7NYJ2_CCR8_MACFA_N term | ANTIGEN | PRT | SEQ ID NO:47 | Y3, Y15, (16), Y17 |
| P56484_CCR8_MOUSE_N term | ANTIGEN | PRT | SEQ ID NO:48 | Y3, Y14, Y15 |
| P51685_CCR8_HUMAN_LID | ANTIGEN | PRT | SEQ ID NO:49 | |
| G7NYJ2_CCR8_MACFA_LID | ANTIGEN | PRT | SEQ ID NO:50 | |
| P56484_CCR8_MOUSE_LID | ANTIGEN | PRT | SEQ ID NO:51 | |
| P51685_CCR8_HUMAN_ECL1 | ANTIGEN | PRT | SEQ ID NO:52 | |
| G7NYJ2_CCR8_MACFA_ECL1 | ANTIGEN | PRT | SEQ ID NO:53 | |
| P56484_CCR8_MOUSE_ECL1 | ANTIGEN | PRT | SEQ ID NO:54 | |
| P51685_CCR8_HUMAN_ECL2 | ANTIGEN | PRT | SEQ ID NO:55 | |
| G7NYJ2_CCR8_MACFA_ECL2 | ANTIGEN | PRT | SEQ ID NO:56 | |
| P56484_CCR8_MOUSE_ECL2 | ANTIGEN | PRT | SEQ ID NO:57 | |
| P51685_CCR8_HUMAN_ECL3 | ANTIGEN | PRT | SEQ ID NO:58 | |
| G7NYJ2_CCR8_MACFA_ECL3 | ANTIGEN | PRT | SEQ ID NO:59 | |
| P56484_CCR8_MOUSE_ECL3 | ANTIGEN | PRT | SEQ ID NO:60 | |
| P51686_CCR9_HUMAN_TRD | ANTIGEN | PRT | SEQ ID NO:61 | Y17, Y28, Y37 |
| Q0H741_CCR9_MACFA_TRD | ANTIGEN | PRT | SEQ ID NO:62 | Y17, Y28, Y37 |
| Q9WUT7_CCR9_MOUSE_TRD | ANTIGEN | PRT | SEQ ID NO:63 | Y19, Y28 |
| P51686_CCR9_HUMAN_N term | ANTIGEN | PRT | SEQ ID NO:64 | Y17, Y28, Y37 |
| Q0H741_CCR9_MACFA_N term | ANTIGEN | PRT | SEQ ID NO:65 | Y17, Y28, Y37 |
| Q9WUT7_CCR9_MOUSE_N term | ANTIGEN | PRT | SEQ ID NO:66 | Y19, Y28 |
| P46092_CCR10_HUMAN_TRD | ANTIGEN | PRT | SEQ ID NO:67 | Y14, Y22 |
| A0A2K5UAP1_CCR10_MACFA_TRD | ANTIGEN | PRT | SEQ ID NO:68 | Y14, Y22 |
| Q9JL21_CCR10_MOUSE_TRD | ANTIGEN | PRT | SEQ ID NO:69 | Y14, Y17, Y22 |
| P46092_CCR10_HUMAN_N term | ANTIGEN | PRT | SEQ ID NO:70 | Y14, Y22 |
| A0A2K5UAP1_CCR10_MACFA_N term | ANTIGEN | PRT | SEQ ID NO:71 | Y14, Y22 |
| Q9JL21_CCR10_MOUSE_N term | ANTIGEN | PRT | SEQ ID NO:72 | Y14, Y17, Y22 |
| P25024_CXCR1_HUMAN_TRD | ANTIGEN | PRT | SEQ ID NO:73 | Y27 |
| A0A2K5X9E4_CXCR1_MACFA_TRD | ANTIGEN | PRT | SEQ ID NO:74 | Y14, Y28 |
| Q810W6_CXCR1_MOUSE_TRD | ANTIGEN | PRT | SEQ ID NO:75 | Y6, Y32 |
| P25024_CXCR1_HUMAN_N term | ANTIGEN | PRT | SEQ ID NO:76 | Y27 |
| A0A2K5X9E4_CXCR1_MACFA_N term | ANTIGEN | PRT | SEQ ID NO:77 | Y14, Y28 |
| Q810W6_CXCR1_MOUSE_N term | ANTIGEN | PRT | SEQ ID NO:78 | Y6, Y32 |
| P25025_CXCR2_HUMAN_TRD | ANTIGEN | PRT | SEQ ID NO:79 | Y23, Y25 |
| Q28519_CXCR2_MACMU_TRD | ANTIGEN | PRT | SEQ ID NO:80 | Y20, Y22 |
| P35343_CXCR2_MOUSE_TRD | ANTIGEN | PRT | SEQ ID NO:81 | Y24 |
| P25025_CXCR2_HUMAN_N term | ANTIGEN | PRT | SEQ ID NO:82 | Y23, Y25 |
| Q28519_CXCR2_MACMU_N term | ANTIGEN | PRT | SEQ ID NO:83 | Y20, Y22 |

| Sequence Name | Sequence Region | Type | SEQ ID | Sulfated |
|---|---|---|---|---|
| P35343_CXCR2_MOUSE_N term | ANTIGEN | PRT | SEQ ID NO:84 | Y24 |
| P49682_CXCR3_HUMAN_TRD | ANTIGEN | PRT | SEQ ID NO:85 | Y27,Y29 |
| A0A2K5UV19_CXCR3_MACFA_TRD | ANTIGEN | PRT | SEQ ID NO:86 | Y27, Y29 |
| O88410_CXCR3_MOUSE_TRD | ANTIGEN | PRT | SEQ ID NO:87 | Y2, Y27,Y29 |
| P49682_CXCR3_HUMAN_N term | ANTIGEN | PRT | SEQ ID NO:88 | Y27,Y29 |
| A0A2K5UV19_CXCR3_MACFA_N term | ANTIGEN | PRT | SEQ ID NO:89 | Y27, Y29 |
| O88410_CXCR3_MOUSE_N term | ANTIGEN | PRT | SEQ ID NO:90 | Y2, Y27,Y29 |
| P61073_CXCR4_HUMAN_TRD | ANTIGEN | PRT | SEQ ID NO:91 | (Y7), Y12, Y21 |
| Q28474_CXCR4_MACFA_TRD | ANTIGEN | PRT | SEQ ID NO:92 | (Y7), Y12, Y21 |
| P70658_CXCR4_MOUSE_TRD | ANTIGEN | PRT | SEQ ID NO:93 | Y9, Y14, Y23 |
| P61073_CXCR4_HUMAN_N term | ANTIGEN | PRT | SEQ ID NO:94 | (Y7), Y12, Y21 |
| Q28474_CXCR4_MACFA_N term | ANTIGEN | PRT | SEQ ID NO:95 | (Y7), Y12, Y21 |
| P70658 CXCR4_MOUSE_N term | ANTIGEN | PRT | SEQ ID NO:96 | Y9, Y14, Y23 |
| P32302 CXCR5_HUMAN_TRD | ANTIGEN | PRT | SEQ ID NO:97 | Y3, Y27 |
| G8F5K4_CXCR5_MACFA_TRD | ANTIGEN | PRT | SEQ ID NO:98 | Y3, Y27 |
| Q04683_CXCR5_MOUSE_TRD | ANTIGEN | PRT | SEQ ID NO:99 | Y3, Y14, Y20, Y26 |
| P32302_CXCR5_HUMAN_N term | ANTIGEN | PRT | SEQ ID NO:100 | Y3, Y27 |
| G8F5K4_CXCR5_MACFA_N term | ANTIGEN | PRT | SEQ ID NO:101 | Y3, Y27 |
| Q04683_CXCR5_MOUSE_N term | ANTIGEN | PRT | SEQ ID NO:102 | Y3, Y14, Y20, Y26 |
| O00574_CXCR6_HUMAN_ TRD | ANTIGEN | PRT | SEQ ID NO:103 | Y6,Y10 |
| Q9BDS6_CXCR6_MACFA_TRD | ANTIGEN | PRT | SEQ ID NO:104 | Y4,Y7, Y39 |
| Q9EQ16_CXCR6_MOUSE_TRD | ANTIGEN | PRT | SEQ ID NO:105 | Y11,(Y15) |
| O00574_CXCR6_HUMAN_N term | ANTIGEN | PRT | SEQ ID NO:106 | Y6,Y10 |
| Q9BDS6_CXCR6_MACFA_N term | ANTIGEN | PRT | SEQ ID NO:107 | Y4,Y7, Y39 |
| Q9EQ16_CXCR6_MOUSE_N term | ANTIGEN | PRT | SEQ ID NO:108 | Y11,(Y15) |
| P32246_CCR1_HUMAN | ANTIGEN | PRT | SEQ ID NO:109 | |
| Q2Y2P0_CCR1_MACFA | ANTIGEN | PRT | SEQ ID NO:110 | |
| P51675_CCR1_MOUSE | ANTIGEN | PRT | SEQ ID NO:111 | |
| P41597_CCR2_HUMAN | ANTIGEN | PRT | SEQ ID NO:112 | |
| O18793_CCR2_MACMU | ANTIGEN | PRT | SEQ ID NO:113 | |
| P51683_CCR2_MOUSE | ANTIGEN | PRT | SEQ ID NO:114 | |
| P51677_CCR3_HUMAN | ANTIGEN | PRT | SEQ ID NO:115 | |
| Q9BDS8_CCR3_MACFA | ANTIGEN | PRT | SEQ ID NO:116 | |
| P51678_CCR3_MOUSE | ANTIGEN | PRT | SEQ ID NO:117 | |
| P51679_CCR4_HUMAN | ANTIGEN | PRT | SEQ ID NO:118 | |
| G7NYB7_CCR4_MACFA | ANTIGEN | PRT | SEQ ID NO:119 | |
| P51680_CCR4_MOUSE | ANTIGEN | PRT | SEQ ID NO:120 | |
| P51681_CCR5_HUMAN | ANTIGEN | PRT | SEQ ID NO:121 | |
| P61814_CCR5_MACFA | ANTIGEN | PRT | SEQ ID NO:122 | |
| P51682_CCR5_MOUSE | ANTIGEN | PRT | SEQ ID NO:123 | |
| P51684_CCR6_HUMAN | ANTIGEN | PRT | SEQ ID NO:124 | |
| A0A2K5WY45_CCR6_MACFA | ANTIGEN | PRT | SEQ ID NO:125 | |
| O54689_CCR6_MOUSE | ANTIGEN | PRT | SEQ ID NO:126 | |
| P32248_CCR7_HUMAN | ANTIGEN | PRT | SEQ ID NO:127 | |
| C0ISS3_CCR7_MACFA | ANTIGEN | PRT | SEQ ID NO:128 | |
| P47774_CCR7_MOUSE | ANTIGEN | PRT | SEQ ID NO:129 | |
| P51685_CCR8_HUMAN | ANTIGEN | PRT | SEQ ID NO:130 | |
| G7NYJ2_CCR8_MACFA | ANTIGEN | PRT | SEQ ID NO:131 | |
| P56484_CCR8_MOUSE | ANTIGEN | PRT | SEQ ID NO:132 | |
| P51686_CCR9_HUMAN | ANTIGEN | PRT | SEQ ID NO:133 | |
| Q0H741_CCR9_MACFA | ANTIGEN | PRT | SEQ ID NO:134 | |
| Q9WUT7_CCR9_MOUSE | ANTIGEN | PRT | SEQ ID NO:135 | |
| P46092_CCR10_HUMAN | ANTIGEN | PRT | SEQ ID NO:136 | |
| A0A2K5UAP1_CCR10_MACFA | ANTIGEN | PRT | SEQ ID NO:137 | |
| Q9JL21_CCR10_MOUSE | ANTIGEN | PRT | SEQ ID NO:138 | |
| P25024_CXCR1_HUMAN | ANTIGEN | PRT | SEQ ID NO:139 | |
| A0A2K5X9E4_CXCR1_MACFA | ANTIGEN | PRT | SEQ ID NO:140 | |
| Q810W6_CXCR1_MOUSE | ANTIGEN | PRT | SEQ ID NO:141 | |
| P25025_CXCR2_HUMAN | ANTIGEN | PRT | SEQ ID NO:142 | |
| Q28519_CXCR2_MACMU | ANTIGEN | PRT | SEQ ID NO:143 | |
| P35343_CXCR2_MOUSE | ANTIGEN | PRT | SEQ ID NO:144 | |
| P49682_CXCR3_HUMAN | ANTIGEN | PRT | SEQ ID NO:145 | |
| A0A2K5UV19_CXCR3_MACFA | ANTIGEN | PRT | SEQ ID NO:146 | |
| O88410_CXCR3_MOUSE | ANTIGEN | PRT | SEQ ID NO:147 | |
| P61073_CXCR4_HUMAN | ANTIGEN | PRT | SEQ ID NO:148 | |
| Q28474_CXCR4_MACFA | ANTIGEN | PRT | SEQ ID NO:149 | |
| P70658_CXCR4_MOUSE | ANTIGEN | PRT | SEQ ID NO:150 | |
| P32302_CXCR5_HUMAN | ANTIGEN | PRT | SEQ ID NO:151 | |
| G8F5K4_CXCR5_MACFA | ANTIGEN | PRT | SEQ ID NO:152 | |
| Q04683_CXCR5_MOUSE | ANTIGEN | PRT | SEQ ID NO:153 | |
| O00574_CXCR6_HUMAN | ANTIGEN | PRT | SEQ ID NO:154 | |
| Q9BDS6_CXCR6_MACFA | ANTIGEN | PRT | SEQ ID NO:155 | |
| Q9EQ16_CXCR6_MOUSE | ANTIGEN | PRT | SEQ ID NO:156 | |
| P49238_CX3CR1_HUMAN_TRD | ANTIGEN | PRT | SEQ ID NO:157 | Y14 |
| Q6Y3J6_CX3CR1_MACFA_TRD | ANTIGEN | PRT | SEQ ID NO:158 | Y20 |
| Q9Z0D9_CX3CR1_MOUSE_TRD | ANTIGEN | PRT | SEQ ID NO:159 | Y15 |

-continued

| Sequence Name | Sequence Region | Type | SEQ ID | Sulfated |
|---|---|---|---|---|
| P49238_CX3CR1_HUMAN_N Term | ANTIGEN | PRT | SEQ ID NO:160 | Y14, Y22 |
| Q6Y3J6_CX3CR1_MACFA_N Term | ANTIGEN | PRT | SEQ ID NO:161 | Y20, Y22 |
| Q9Z0D9_CX3CR1_MOUSE_N Term | ANTIGEN | PRT | SEQ ID NO:162 | Y15, Y23 |
| P25024_CXCR1_HUMAN_TRD | ANTIGEN | PRT | SEQ ID NO:163 | Y27 |
| Q2YEG0_CXCR1_MACMU_TRD | ANTIGEN | PRT | SEQ ID NO:164 | Y14, Y28 |
| Q810W6_CXCR1_MOUSE_TRD | ANTIGEN | PRT | SEQ ID NO:165 | Y6, Y32 |
| P25024_CXCR1_HUMAN_N Term | ANTIGEN | PRT | SEQ ID NO:166 | Y27 |
| Q2YEG0_CXCR1_MACMU_N Term | ANTIGEN | PRT | SEQ ID NO:167 | Y14, Y28, Y41 |
| Q810W6_CXCR1_MOUSE_N Term | ANTIGEN | PRT | SEQ ID NO:168 | Y6, Y32 |

| TPP ID | Sequence Name | Sequence Region | Type | SEQ ID |
|---|---|---|---|---|
| TPP-14095 | 497A-M005-E07-hIgG1Lambda | VH | PRT | SEQ ID NO:201 |
| TPP-14095 | 497A-M005-E07-hIgG1Lambda | HCDR1 | PRT | SEQ ID NO:202 |
| TPP-14095 | 497A-M005-E07-hIgG1Lambda | HCDR2 | PRT | SEQ ID NO:203 |
| TPP-14095 | 497A-M005-E07-hIgG1Lambda | HCDR3 | PRT | SEQ ID NO:204 |
| TPP-14095 | 497A-M005-E07-hIgG1Lambda | VL | PRT | SEQ ID NO:205 |
| TPP-14095 | 497A-M005-E07-hIgG1Lambda | LCDR1 | PRT | SEQ ID NO:206 |
| TPP-14095 | 497A-M005-E07-hIgG1Lambda | LCDR2 | PRT | SEQ ID NO:207 |
| TPP-14095 | 497A-M005-E07-hIgG1Lambda | LCDR3 | PRT | SEQ ID NO:208 |
| TPP-14095 | 497A-M005-E07-hIgG1Lambda | VH | DNA | SEQ ID NO:209 |
| TPP-14095 | 497A-M005-E07-hIgG1Lambda | VL | DNA | SEQ ID NO:210 |
| TPP-14095 | 497A-M005-E07-hIgG1Lambda | HC | PRT | SEQ ID NO:211 |
| TPP-14095 | 497A-M005-E07-hIgG1Lambda | LC | PRT | SEQ ID NO:212 |
| TPP-14095 | 497A-M005-E07-hIgG1Lambda | HC | DNA | SEQ ID NO:213 |
| TPP-14095 | 497A-M005-E07-hIgG1Lambda | LC | DNA | SEQ ID NO:214 |
| TPP-14099 | 497A-M005-F02-hIgG1Lambda | VH | PRT | SEQ ID NO:215 |
| TPP-14099 | 497A-M005-F02-hIgG1Lambda | HCDR1 | PRT | SEQ ID NO:216 |
| TPP-14099 | 497A-M005-F02-hIgG1Lambda | HCDR2 | PRT | SEQ ID NO:217 |
| TPP-14099 | 497A-M005-F02-hIgG1Lambda | HCDR3 | PRT | SEQ ID NO:218 |
| TPP-14099 | 497A-M005-F02-hIgG1Lambda | VL | PRT | SEQ ID NO:219 |
| TPP-14099 | 497A-M005-F02-hIgG1Lambda | LCDR1 | PRT | SEQ ID NO:220 |
| TPP-14099 | 497A-M005-F02-hIgG1Lambda | LCDR2 | PRT | SEQ ID NO:221 |
| TPP-14099 | 497A-M005-F02-hIgG1Lambda | LCDR3 | PRT | SEQ ID NO:222 |
| TPP-14099 | 497A-M005-F02-hIgG1Lambda | VH | DNA | SEQ ID NO:223 |
| TPP-14099 | 497A-M005-F02-hIgG1Lambda | VL | DNA | SEQ ID NO:224 |
| TPP-14099 | 497A-M005-F02-hIgG1Lambda | HC | PRT | SEQ ID NO:225 |
| TPP-14099 | 497A-M005-F02-hIgG1Lambda | LC | PRT | SEQ ID NO:226 |
| TPP-14099 | 497A-M005-F02-hIgG1Lambda | HC | DNA | SEQ ID NO:227 |
| TPP-14099 | 497A-M005-F02-hIgG1Lambda | LC | DNA | SEQ ID NO:228 |
| TPP-15285 | 497A-M005-F02-mIgG2aLambda | VH | PRT | SEQ ID NO:229 |
| TPP-15285 | 497A-M005-F02-mIgG2aLambda | HCDR1 | PRT | SEQ ID NO:230 |
| TPP-15285 | 497A-M005-F02-mIgG2aLambda | HCDR2 | PRT | SEQ ID NO:231 |
| TPP-15285 | 497A-M005-F02-mIgG2aLambda | HCDR3 | PRT | SEQ ID NO:232 |
| TPP-15285 | 497A-M005-F02-mIgG2aLambda | VL | PRT | SEQ ID NO:233 |
| TPP-15285 | 497A-M005-F02-mIgG2aLambda | LCDR1 | PRT | SEQ ID NO:234 |
| TPP-15285 | 497A-M005-F02-mIgG2aLambda | LCDR2 | PRT | SEQ ID NO:235 |
| TPP-15285 | 497A-M005-F02-mIgG2aLambda | LCDR3 | PRT | SEQ ID NO:236 |
| TPP-15285 | 497A-M005-F02-mIgG2aLambda | VH | DNA | SEQ ID NO:237 |
| TPP-15285 | 497A-M005-F02-mIgG2aLambda | VL | DNA | SEQ ID NO:238 |
| TPP-15285 | 497A-M005-F02-mIgG2aLambda | HC | PRT | SEQ ID NO:239 |
| TPP-15285 | 497A-M005-F02-mIgG2aLambda | LC | PRT | SEQ ID NO:240 |
| TPP-15285 | 497A-M005-F02-mIgG2aLambda | HC | DNA | SEQ ID NO:241 |
| TPP-15285 | 497A-M005-F02-mIgG2aLambda | LC | DNA | SEQ ID NO:242 |
| TPP-15286 | 497A-M005-E07-mIgG2aLambda | VH | PRT | SEQ ID NO:243 |
| TPP-15286 | 497A-M005-E07-mIgG2aLambda | HCDR1 | PRT | SEQ ID NO:244 |
| TPP-15286 | 497A-M005-E07-mIgG2aLambda | HCDR2 | PRT | SEQ ID NO:245 |
| TPP-15286 | 497A-M005-E07-mIgG2aLambda | HCDR3 | PRT | SEQ ID NO:246 |
| TPP-15286 | 497A-M005-E07-mIgG2aLambda | VL | PRT | SEQ ID NO:247 |
| TPP-15286 | 497A-M005-E07-mIgG2aLambda | LCDR1 | PRT | SEQ ID NO:248 |
| TPP-15286 | 497A-M005-E07-mIgG2aLambda | LCDR2 | PRT | SEQ ID NO:249 |
| TPP-15286 | 497A-M005-E07-mIgG2aLambda | LCDR3 | PRT | SEQ ID NO:250 |
| TPP-15286 | 497A-M005-E07-mIgG2aLambda | VH | DNA | SEQ ID NO:251 |
| TPP-15286 | 497A-M005-E07-mIgG2aLambda | VL | DNA | SEQ ID NO:252 |
| TPP-15286 | 497A-M005-E07-mIgG2aLambda | HC | PRT | SEQ ID NO:253 |
| TPP-15286 | 497A-M005-E07-mIgG2aLambda | LC | PRT | SEQ ID NO:254 |
| TPP-15286 | 497A-M005-E07-mIgG2aLambda | HC | DNA | SEQ ID NO:255 |
| TPP-15286 | 497A-M005-E07-mIgG2aLambda | LC | DNA | SEQ ID NO:256 |
| TPP-16966 | 15291-deglyco-hIgG1Lambda | VH | PRT | SEQ ID NO:257 |
| TPP-16966 | 15291-deglyco-hIgG1Lambda | HCDR1 | PRT | SEQ ID NO:258 |
| TPP-16966 | 15291-deglyco-hIgG1Lambda | HCDR2 | PRT | SEQ ID NO:259 |
| TPP-16966 | 15291-deglyco-hIgG1Lambda | HCDR3 | PRT | SEQ ID NO:260 |

-continued

| TPP ID | Sequence Name | Sequence Region | Type | SEQ ID |
|---|---|---|---|---|
| TPP-16966 | 15291-deglyco-hIgG1Lambda | VL | PRT | SEQ ID NO:261 |
| TPP-16966 | 15291-deglyco-hIgG1Lambda | LCDR1 | PRT | SEQ ID NO:262 |
| TPP-16966 | 15291-deglyco-hIgG1Lambda | LCDR2 | PRT | SEQ ID NO:263 |
| TPP-16966 | 15291-deglyco-hIgG1Lambda | LCDR3 | PRT | SEQ ID NO:264 |
| TPP-16966 | 15291-deglyco-hIgG1Lambda | VH | DNA | SEQ ID NO:265 |
| TPP-16966 | 15291-deglyco-hIgG1Lambda | HCDR1 | DNA | SEQ ID NO:266 |
| TPP-16966 | 15291-deglyco-hIgG1Lambda | HCDR2 | DNA | SEQ ID NO:267 |
| TPP-16966 | 15291-deglyco-hIgG1Lambda | HCDR3 | DNA | SEQ ID NO:268 |
| TPP-16966 | 15291-deglyco-hIgG1Lambda | VL | DNA | SEQ ID NO:269 |
| TPP-16966 | 15291-deglyco-hIgG1Lambda | LCDR1 | DNA | SEQ ID NO:270 |
| TPP-16966 | 15291-deglyco-hIgG1Lambda | LCDR2 | DNA | SEQ ID NO:271 |
| TPP-16966 | 15291-deglyco-hIgG1Lambda | LCDR3 | DNA | SEQ ID NO:272 |
| TPP-16966 | 15291-deglyco-hIgG1Lambda | HC | PRT | SEQ ID NO:273 |
| TPP-16966 | 15291-deglyco-hIgG1Lambda | LC | PRT | SEQ ID NO:274 |
| TPP-17575 | 497A-M181-C17-1-hIgG1Lambda | VH | PRT | SEQ ID NO:275 |
| TPP-17575 | 497A-M181-C17-1-hIgG1Lambda | HCDR1 | PRT | SEQ ID NO:276 |
| TPP-17575 | 497A-M181-C17-1-hIgG1Lambda | HCDR2 | PRT | SEQ ID NO:277 |
| TPP-17575 | 497A-M181-C17-1-hIgG1Lambda | HCDR3 | PRT | SEQ ID NO:278 |
| TPP-17575 | 497A-M181-C17-1-hIgG1Lambda | VL | PRT | SEQ ID NO:279 |
| TPP-17575 | 497A-M181-C17-1-hIgG1Lambda | LCDR1 | PRT | SEQ ID NO:280 |
| TPP-17575 | 497A-M181-C17-1-hIgG1Lambda | LCDR2 | PRT | SEQ ID NO:281 |
| TPP-17575 | 497A-M181-C17-1-hIgG1Lambda | LCDR3 | PRT | SEQ ID NO:282 |
| TPP-17575 | 497A-M181-C17-1-hIgG1Lambda | VH | DNA | SEQ ID NO:283 |
| TPP-17575 | 497A-M181-C17-1-hIgG1Lambda | HCDR1 | DNA | SEQ ID NO:284 |
| TPP-17575 | 497A-M181-C17-1-hIgG1Lambda | HCDR2 | DNA | SEQ ID NO:285 |
| TPP-17575 | 497A-M181-C17-1-hIgG1Lambda | HCDR3 | DNA | SEQ ID NO:286 |
| TPP-17575 | 497A-M181-C17-1-hIgG1Lambda | VL | DNA | SEQ ID NO:287 |
| TPP-17575 | 497A-M181-C17-1-hIgG1Lambda | LCDR1 | DNA | SEQ ID NO:288 |
| TPP-17575 | 497A-M181-C17-1-hIgG1Lambda | LCDR2 | DNA | SEQ ID NO:289 |
| TPP-17575 | 497A-M181-C17-1-hIgG1Lambda | LCDR3 | DNA | SEQ ID NO:290 |
| TPP-17575 | 497A-M181-C17-1-hIgG1Lambda | HC | PRT | SEQ ID NO:291 |
| TPP-17575 | 497A-M181-C17-1-hIgG1Lambda | LC | PRT | SEQ ID NO:292 |
| TPP-17576 | 497A-M136-O21-1-hIgG1Lambda | VH | PRT | SEQ ID NO:293 |
| TPP-17576 | 497A-M136-O21-1-hIgG1Lambda | HCDR1 | PRT | SEQ ID NO:294 |
| TPP-17576 | 497A-M136-O21-1-hIgG1Lambda | HCDR2 | PRT | SEQ ID NO:295 |
| TPP-17576 | 497A-M136-O21-1-hIgG1Lambda | HCDR3 | PRT | SEQ ID NO:296 |
| TPP-17576 | 497A-M136-O21-1-hIgG1Lambda | VL | PRT | SEQ ID NO:297 |
| TPP-17576 | 497A-M136-O21-1-hIgG1Lambda | LCDR1 | PRT | SEQ ID NO:298 |
| TPP-17576 | 497A-M136-O21-1-hIgG1Lambda | LCDR2 | PRT | SEQ ID NO:299 |
| TPP-17576 | 497A-M136-O21-1-hIgG1Lambda | LCDR3 | PRT | SEQ ID NO:300 |
| TPP-17576 | 497A-M136-O21-1-hIgG1Lambda | VH | DNA | SEQ ID NO:301 |
| TPP-17576 | 497A-M136-O21-1-hIgG1Lambda | HCDR1 | DNA | SEQ ID NO:302 |
| TPP-17576 | 497A-M136-O21-1-hIgG1Lambda | HCDR2 | DNA | SEQ ID NO:303 |
| TPP-17576 | 497A-M136-O21-1-hIgG1Lambda | HCDR3 | DNA | SEQ ID NO:304 |
| TPP-17576 | 497A-M136-O21-1-hIgG1Lambda | VL | DNA | SEQ ID NO:305 |
| TPP-17576 | 497A-M136-O21-1-hIgG1Lambda | LCDR1 | DNA | SEQ ID NO:306 |
| TPP-17576 | 497A-M136-O21-1-hIgG1Lambda | LCDR2 | DNA | SEQ ID NO:307 |
| TPP-17576 | 497A-M136-O21-1-hIgG1Lambda | LCDR3 | DNA | SEQ ID NO:308 |
| TPP-17576 | 497A-M136-O21-1-hIgG1Lambda | HC | PRT | SEQ ID NO:309 |
| TPP-17576 | 497A-M136-O21-1-hIgG1Lambda | LC | PRT | SEQ ID NO:310 |
| TPP-17577 | 497A-M178-K09-1-hIgG1Lambda | VH | PRT | SEQ ID NO:311 |
| TPP-17577 | 497A-M178-K09-1-hIgG1Lambda | HCDR1 | PRT | SEQ ID NO:312 |
| TPP-17577 | 497A-M178-K09-1-hIgG1Lambda | HCDR2 | PRT | SEQ ID NO:313 |
| TPP-17577 | 497A-M178-K09-1-hIgG1Lambda | HCDR3 | PRT | SEQ ID NO:314 |
| TPP-17577 | 497A-M178-K09-1-hIgG1Lambda | VL | PRT | SEQ ID NO:315 |
| TPP-17577 | 497A-M178-K09-1-hIgG1Lambda | LCDR1 | PRT | SEQ ID NO:316 |
| TPP-17577 | 497A-M178-K09-1-hIgG1Lambda | LCDR2 | PRT | SEQ ID NO:317 |
| TPP-17577 | 497A-M178-K09-1-hIgG1Lambda | LCDR3 | PRT | SEQ ID NO:318 |
| TPP-17577 | 497A-M178-K09-1-hIgG1Lambda | VH | DNA | SEQ ID NO:319 |
| TPP-17577 | 497A-M178-K09-1-hIgG1Lambda | HCDR1 | DNA | SEQ ID NO:320 |
| TPP-17577 | 497A-M178-K09-1-hIgG1Lambda | HCDR2 | DNA | SEQ ID NO:321 |
| TPP-17577 | 497A-M178-K09-1-hIgG1Lambda | HCDR3 | DNA | SEQ ID NO:322 |
| TPP-17577 | 497A-M178-K09-1-hIgG1Lambda | VL | DNA | SEQ ID NO:323 |
| TPP-17577 | 497A-M178-K09-1-hIgG1Lambda | LCDR1 | DNA | SEQ ID NO:324 |
| TPP-17577 | 497A-M178-K09-1-hIgG1Lambda | LCDR2 | DNA | SEQ ID NO:325 |
| TPP-17577 | 497A-M178-K09-1-hIgG1Lambda | LCDR3 | DNA | SEQ ID NO:326 |
| TPP-17577 | 497A-M178-K09-1-hIgG1Lambda | HC | PRT | SEQ ID NO:327 |
| TPP-17577 | 497A-M178-K09-1-hIgG1Lambda | LC | PRT | SEQ ID NO:328 |
| TPP-17578 | 497A-M128-B10-1-hIgG1Lambda | VH | PRT | SEQ ID NO:329 |
| TPP-17578 | 497A-M128-B10-1-hIgG1Lambda | HCDR1 | PRT | SEQ ID NO:330 |
| TPP-17578 | 497A-M128-B10-1-hIgG1Lambda | HCDR2 | PRT | SEQ ID NO:331 |
| TPP-17578 | 497A-M128-B10-1-hIgG1Lambda | HCDR3 | PRT | SEQ ID NO:332 |
| TPP-17578 | 497A-M128-B10-1-hIgG1Lambda | VL | PRT | SEQ ID NO:333 |
| TPP-17578 | 497A-M128-B10-1-hIgG1Lambda | LCDR1 | PRT | SEQ ID NO:334 |
| TPP-17578 | 497A-M128-B10-1-hIgG1Lambda | LCDR2 | PRT | SEQ ID NO:335 |
| TPP-17578 | 497A-M128-B10-1-hIgG1Lambda | LCDR3 | PRT | SEQ ID NO:336 |

-continued

| TPP ID | Sequence Name | Sequence Region | Type | SEQ ID |
|---|---|---|---|---|
| TPP-17578 | 497A-M128-B10-1-hIgG1Lambda | VH | DNA | SEQ ID NO:337 |
| TPP-17578 | 497A-M128-B10-1-hIgG1Lambda | HCDR1 | DNA | SEQ ID NO:338 |
| TPP-17578 | 497A-M128-B10-1-hIgG1Lambda | HCDR2 | DNA | SEQ ID NO:339 |
| TPP-17578 | 497A-M128-B10-1-hIgG1Lambda | HCDR3 | DNA | SEQ ID NO:340 |
| TPP-17578 | 497A-M128-B10-1-hIgG1Lambda | VL | DNA | SEQ ID NO:341 |
| TPP-17578 | 497A-M128-B10-1-hIgG1Lambda | LCDR1 | DNA | SEQ ID NO:342 |
| TPP-17578 | 497A-M128-B10-1-hIgG1Lambda | LCDR2 | DNA | SEQ ID NO:343 |
| TPP-17578 | 497A-M128-B10-1-hIgG1Lambda | LCDR3 | DNA | SEQ ID NO:344 |
| TPP-17578 | 497A-M128-B10-1-hIgG1Lambda | HC | PRT | SEQ ID NO:345 |
| TPP-17578 | 497A-M128-B10-1-hIgG1Lambda | LC | PRT | SEQ ID NO:346 |
| TPP-17579 | 497A-M180-K04-1-hIgG1Lambda | VH | PRT | SEQ ID NO:347 |
| TPP-17579 | 497A-M180-K04-1-hIgG1Lambda | HCDR1 | PRT | SEQ ID NO:348 |
| TPP-17579 | 497A-M180-K04-1-hIgG1Lambda | HCDR2 | PRT | SEQ ID NO:349 |
| TPP-17579 | 497A-M180-K04-1-hIgG1Lambda | HCDR3 | PRT | SEQ ID NO:350 |
| TPP-17579 | 497A-M180-K04-1-hIgG1Lambda | VL | PRT | SEQ ID NO:351 |
| TPP-17579 | 497A-M180-K04-1-hIgG1Lambda | LCDR1 | PRT | SEQ ID NO:352 |
| TPP-17579 | 497A-M180-K04-1-hIgG1Lambda | LCDR2 | PRT | SEQ ID NO:353 |
| TPP-17579 | 497A-M180-K04-1-hIgG1Lambda | LCDR3 | PRT | SEQ ID NO:354 |
| TPP-17579 | 497A-M180-K04-1-hIgG1Lambda | VH | DNA | SEQ ID NO:355 |
| TPP-17579 | 497A-M180-K04-1-hIgG1Lambda | HCDR1 | DNA | SEQ ID NO:356 |
| TPP-17579 | 497A-M180-K04-1-hIgG1Lambda | HCDR2 | DNA | SEQ ID NO:357 |
| TPP-17579 | 497A-M180-K04-1-hIgG1Lambda | HCDR3 | DNA | SEQ ID NO:358 |
| TPP-17579 | 497A-M180-K04-1-hIgG1Lambda | VL | DNA | SEQ ID NO:359 |
| TPP-17579 | 497A-M180-K04-1-hIgG1Lambda | LCDR1 | DNA | SEQ ID NO:360 |
| TPP-17579 | 497A-M180-K04-1-hIgG1Lambda | LCDR2 | DNA | SEQ ID NO:361 |
| TPP-17579 | 497A-M180-K04-1-hIgG1Lambda | LCDR3 | DNA | SEQ ID NO:362 |
| TPP-17579 | 497A-M180-K04-1-hIgG1Lambda | HC | PRT | SEQ ID NO:363 |
| TPP-17579 | 497A-M180-K04-1-hIgG1Lambda | LC | PRT | SEQ ID NO:364 |
| TPP-17580 | 497A-M193-A08-1-hIgG1Lambda | VH | PRT | SEQ ID NO:365 |
| TPP-17580 | 497A-M193-A08-1-hIgG1Lambda | HCDR1 | PRT | SEQ ID NO:366 |
| TPP-17580 | 497A-M193-A08-1-hIgG1Lambda | HCDR2 | PRT | SEQ ID NO:367 |
| TPP-17580 | 497A-M193-A08-1-hIgG1Lambda | HCDR3 | PRT | SEQ ID NO:368 |
| TPP-17580 | 497A-M193-A08-1-hIgG1Lambda | VL | PRT | SEQ ID NO:369 |
| TPP-17580 | 497A-M193-A08-1-hIgG1Lambda | LCDR1 | PRT | SEQ ID NO:370 |
| TPP-17580 | 497A-M193-A08-1-hIgG1Lambda | LCDR2 | PRT | SEQ ID NO:371 |
| TPP-17580 | 497A-M193-A08-1-hIgG1Lambda | LCDR3 | PRT | SEQ ID NO:372 |
| TPP-17580 | 497A-M193-A08-1-hIgG1Lambda | VH | DNA | SEQ ID NO:373 |
| TPP-17580 | 497A-M193-A08-1-hIgG1Lambda | HCDR1 | DNA | SEQ ID NO:374 |
| TPP-17580 | 497A-M193-A08-1-hIgG1Lambda | HCDR2 | DNA | SEQ ID NO:375 |
| TPP-17580 | 497A-M193-A08-1-hIgG1Lambda | HCDR3 | DNA | SEQ ID NO:376 |
| TPP-17580 | 497A-M193-A08-1-hIgG1Lambda | VL | DNA | SEQ ID NO:377 |
| TPP-17580 | 497A-M193-A08-1-hIgG1Lambda | LCDR1 | DNA | SEQ ID NO:378 |
| TPP-17580 | 497A-M193-A08-1-hIgG1Lambda | LCDR2 | DNA | SEQ ID NO:379 |
| TPP-17580 | 497A-M193-A08-1-hIgG1Lambda | LCDR3 | DNA | SEQ ID NO:380 |
| TPP-17580 | 497A-M193-A08-1-hIgG1Lambda | HC | PRT | SEQ ID NO:381 |
| TPP-17580 | 497A-M193-A08-1-hIgG1Lambda | LC | PRT | SEQ ID NO:382 |
| TPP-17581 | 497A-M177-L03-1-hIgG1Lambda | VH | PRT | SEQ ID NO:383 |
| TPP-17581 | 497A-M177-L03-1-hIgG1Lambda | HCDR1 | PRT | SEQ ID NO:384 |
| TPP-17581 | 497A-M177-L03-1-hIgG1Lambda | HCDR2 | PRT | SEQ ID NO:385 |
| TPP-17581 | 497A-M177-L03-1-hIgG1Lambda | HCDR3 | PRT | SEQ ID NO:386 |
| TPP-17581 | 497A-M177-L03-1-hIgG1Lambda | VL | PRT | SEQ ID NO:387 |
| TPP-17581 | 497A-M177-L03-1-hIgG1Lambda | LCDR1 | PRT | SEQ ID NO:388 |
| TPP-17581 | 497A-M177-L03-1-hIgG1Lambda | LCDR2 | PRT | SEQ ID NO:389 |
| TPP-17581 | 497A-M177-L03-1-hIgG1Lambda | LCDR3 | PRT | SEQ ID NO:390 |
| TPP-17581 | 497A-M177-L03-1-hIgG1Lambda | VH | DNA | SEQ ID NO:391 |
| TPP-17581 | 497A-M177-L03-1-hIgG1Lambda | HCDR1 | DNA | SEQ ID NO:392 |
| TPP-17581 | 497A-M177-L03-1-hIgG1Lambda | HCDR2 | DNA | SEQ ID NO:393 |
| TPP-17581 | 497A-M177-L03-1-hIgG1Lambda | HCDR3 | DNA | SEQ ID NO:394 |
| TPP-17581 | 497A-M177-L03-1-hIgG1Lambda | VL | DNA | SEQ ID NO:395 |
| TPP-17581 | 497A-M177-L03-1-hIgG1Lambda | LCDR1 | DNA | SEQ ID NO:396 |
| TPP-17581 | 497A-M177-L03-1-hIgG1Lambda | LCDR2 | DNA | SEQ ID NO:397 |
| TPP-17581 | 497A-M177-L03-1-hIgG1Lambda | LCDR3 | DNA | SEQ ID NO:398 |
| TPP-17581 | 497A-M177-L03-1-hIgG1Lambda | HC | PRT | SEQ ID NO:399 |
| TPP-17581 | 497A-M177-L03-1-hIgG1Lambda | LC | PRT | SEQ ID NO:400 |
| TPP-18205 | 004-F10_497A-M296-L12+497A-M326-O09-hIgG1Lambda | VH | PRT | SEQ ID NO:401 |
| TPP-18205 | 004-F10_497A-M296-L12+497A-M326-O09-hIgG1Lambda | HCDR1 | PRT | SEQ ID NO:402 |
| TPP-18205 | 004-F10_497A-M296-L12+497A-M326-O09-hIgG1Lambda | HCDR2 | PRT | SEQ ID NO:403 |
| TPP-18205 | 004-F10_497A-M296-L12+497A-M326-O09-hIgG1Lambda | HCDR3 | PRT | SEQ ID NO:404 |
| TPP-18205 | 004-F10_497A-M296-L12+497A-M326-O09-hIgG1Lambda | VL | PRT | SEQ ID NO:405 |
| TPP-18205 | 004-F10_497A-M296-L12+497A-M326-O09-hIgG1Lambda | LCDR1 | PRT | SEQ ID NO:406 |

| TPP ID | Sequence Name | Sequence Region | Type | SEQ ID |
| --- | --- | --- | --- | --- |
| TPP-18205 | 004-F10_497A-M296-L12+497A-M326-O09-hIgG1Lambda | LCDR2 | PRT | SEQ ID NO:407 |
| TPP-18205 | 004-F10_497A-M296-L12+497A-M326-O09-hIgG1Lambda | LCDR3 | PRT | SEQ ID NO:408 |
| TPP-18205 | 004-F10_497A-M296-L12+497A-M326-O09-hIgG1Lambda | VH | DNA | SEQ ID NO:409 |
| TPP-18205 | 004-F10_497A-M296-L12+497A-M326-O09-hIgG1Lambda | HCDR1 | DNA | SEQ ID NO:410 |
| TPP-18205 | 004-F10_497A-M296-L12+497A-M326-O09-hIgG1Lambda | HCDR2 | DNA | SEQ ID NO:411 |
| TPP-18205 | 004-F10_497A-M296-L12+497A-M326-O09-hIgG1Lambda | HCDR3 | DNA | SEQ ID NO:412 |
| TPP-18205 | 004-F10_497A-M296-L12+497A-M326-O09-hIgG1Lambda | VL | DNA | SEQ ID NO:413 |
| TPP-18205 | 004-F10_497A-M296-L12+497A-M326-O09-hIgG1Lambda | LCDR1 | DNA | SEQ ID NO:414 |
| TPP-18205 | 004-F10_497A-M296-L12+497A-M326-O09-hIgG1Lambda | LCDR2 | DNA | SEQ ID NO:415 |
| TPP-18205 | 004-F10_497A-M296-L12+497A-M326-O09-hIgG1Lambda | LCDR3 | DNA | SEQ ID NO:416 |
| TPP-18205 | 004-F10_497A-M296-L12+497A-M326-O09-hIgG1Lambda | HC | PRT | SEQ ID NO:417 |
| TPP-18205 | 004-F10_497A-M296-L12+497A-M326-O09-hIgG1Lambda | LC | PRT | SEQ ID NO:418 |
| TPP-18206 | 002-F01_497A-M281-P02+497A-M317-O07-hIgG1Lambda | VH | PRT | SEQ ID NO:419 |
| TPP-18206 | 002-F01_497A-M281-P02+497A-M317-O07-hIgG1Lambda | HCDR1 | PRT | SEQ ID NO:420 |
| TPP-18206 | 002-F01_497A-M281-P02+497A-M317-O07-hIgG1Lambda | HCDR2 | PRT | SEQ ID NO:421 |
| TPP-18206 | 002-F01_497A-M281-P02+497A-M317-O07-hIgG1Lambda | HCDR3 | PRT | SEQ ID NO:422 |
| TPP-18206 | 002-F01_497A-M281-P02+497A-M317-O07-hIgG1Lambda | VL | PRT | SEQ ID NO:423 |
| TPP-18206 | 002-F01_497A-M281-P02+497A-M317-O07-hIgG1Lambda | LCDR1 | PRT | SEQ ID NO:424 |
| TPP-18206 | 002-F01_497A-M281-P02+497A-M317-O07-hIgG1Lambda | LCDR2 | PRT | SEQ ID NO:425 |
| TPP-18206 | 002-F01_497A-M281-P02+497A-M317-O07-hIgG1Lambda | LCDR3 | PRT | SEQ ID NO:426 |
| TPP-18206 | 002-F01_497A-M281-P02+497A-M317-O07-hIgG1Lambda | VH | DNA | SEQ ID NO:427 |
| TPP-18206 | 002-F01_497A-M281-P02+497A-M317-O07-hIgG1Lambda | HCDR1 | DNA | SEQ ID NO:428 |
| TPP-18206 | 002-F01_497A-M281-P02+497A-M317-O07-hIgG1Lambda | HCDR2 | DNA | SEQ ID NO:429 |
| TPP-18206 | 002-F01_497A-M281-P02+497A-M317-O07-hIgG1Lambda | HCDR3 | DNA | SEQ ID NO:430 |
| TPP-18206 | 002-F01_497A-M281-P02+497A-M317-O07-hIgG1Lambda | VL | DNA | SEQ ID NO:431 |
| TPP-18206 | 002-F01_497A-M281-P02+497A-M317-O07-hIgG1Lambda | LCDR1 | DNA | SEQ ID NO:432 |
| TPP-18206 | 002-F01_497A-M281-P02+497A-M317-O07-hIgG1Lambda | LCDR2 | DNA | SEQ ID NO:433 |
| TPP-18206 | 002-F01_497A-M281-P02+497A-M317-O07-hIgG1Lambda | LCDR3 | DNA | SEQ ID NO:434 |
| TPP-18206 | 002-F01_497A-M281-P02+497A-M317-O07-hIgG1Lambda | HC | PRT | SEQ ID NO:435 |
| TPP-18206 | 002-F01_497A-M281-P02+497A-M317-O07-hIgG1Lambda | LC | PRT | SEQ ID NO:436 |
| TPP-18207 | 001-B08_497A-M301-B18+497A-M316-D16-hIgG1Lambda | VH | PRT | SEQ ID NO:437 |
| TPP-18207 | 001-B08_497A-M301-B18+497A-M316-D16-hIgG1Lambda | HCDR1 | PRT | SEQ ID NO:438 |
| TPP-18207 | 001-B08_497A-M301-B18+497A-M316-D16-hIgG1Lambda | HCDR2 | PRT | SEQ ID NO:439 |
| TPP-18207 | 001-B08_497A-M301-B18+497A-M316-D16-hIgG1Lambda | HCDR3 | PRT | SEQ ID NO:440 |
| TPP-18207 | 001-B08_497A-M301-B18+497A-M316-D16-hIgG1Lambda | VL | PRT | SEQ ID NO:441 |
| TPP-18207 | 001-B08_497A-M301-B18+497A-M316-D16-hIgG1Lambda | LCDR1 | PRT | SEQ ID NO:442 |
| TPP-18207 | 001-B08_497A-M301-B18+497A-M316-D16-hIgG1Lambda | LCDR2 | PRT | SEQ ID NO:443 |
| TPP-18207 | 001-B08_497A-M301-B18+497A-M316-D16-hIgG1Lambda | LCDR3 | PRT | SEQ ID NO:444 |

-continued

| TPP ID | Sequence Name | Sequence Region | Type | SEQ ID |
|---|---|---|---|---|
| TPP-18207 | 001-B08_497A-M301-B18+497A-M316-D16-hIgG1Lambda | VH | DNA | SEQ ID NO:445 |
| TPP-18207 | 001-B08_497A-M301-B18+497A-M316-D16-hIgG1Lambda | HCDR1 | DNA | SEQ ID NO:446 |
| TPP-18207 | 001-B08_497A-M301-B18+497A-M316-D16-hIgG1Lambda | HCDR2 | DNA | SEQ ID NO:447 |
| TPP-18207 | 001-B08_497A-M301-B18+497A-M316-D16-hIgG1Lambda | HCDR3 | DNA | SEQ ID NO:448 |
| TPP-18207 | 001-B08_497A-M301-B18+497A-M316-D16-hIgG1Lambda | VL | DNA | SEQ ID NO:449 |
| TPP-18207 | 001-B08_497A-M301-B18+497A-M316-D16-hIgG1Lambda | LCDR1 | DNA | SEQ ID NO:450 |
| TPP-18207 | 001-B08_497A-M301-B18+497A-M316-D16-hIgG1Lambda | LCDR2 | DNA | SEQ ID NO:451 |
| TPP-18207 | 001-B08_497A-M301-B18+497A-M316-D16-hIgG1Lambda | LCDR3 | DNA | SEQ ID NO:452 |
| TPP-18207 | 001-B08_497A-M301-B18+497A-M316-D16-hIgG1Lambda | HC | PRT | SEQ ID NO:453 |
| TPP-18207 | 001-B08_497A-M301-B18+497A-M316-D16-hIgG1Lambda | LC | PRT | SEQ ID NO:454 |
| TPP-19546 | 17578-gl33-hIgG1Lambda | VH | PRT | SEQ ID NO:455 |
| TPP-19546 | 17578-gl33-hIgG1Lambda | HCDR1 | PRT | SEQ ID NO:456 |
| TPP-19546 | 17578-gl33-hIgG1Lambda | HCDR2 | PRT | SEQ ID NO:457 |
| TPP-19546 | 17578-gl33-hIgG1Lambda | HCDR3 | PRT | SEQ ID NO:458 |
| TPP-19546 | 17578-gl33-hIgG1Lambda | VL | PRT | SEQ ID NO:459 |
| TPP-19546 | 17578-gl33-hIgG1Lambda | LCDR1 | PRT | SEQ ID NO:460 |
| TPP-19546 | 17578-gl33-hIgG1Lambda | LCDR2 | PRT | SEQ ID NO:461 |
| TPP-19546 | 17578-gl33-hIgG1Lambda | LCDR3 | PRT | SEQ ID NO:462 |
| TPP-19546 | 17578-gl33-hIgG1Lambda | VH | DNA | SEQ ID NO:463 |
| TPP-19546 | 17578-gl33-hIgG1Lambda | HCDR1 | DNA | SEQ ID NO:464 |
| TPP-19546 | 17578-gl33-hIgG1Lambda | HCDR2 | DNA | SEQ ID NO:465 |
| TPP-19546 | 17578-gl33-hIgG1Lambda | HCDR3 | DNA | SEQ ID NO:466 |
| TPP-19546 | 17578-gl33-hIgG1Lambda | VL | DNA | SEQ ID NO:467 |
| TPP-19546 | 17578-gl33-hIgG1Lambda | LCDR1 | DNA | SEQ ID NO:468 |
| TPP-19546 | 17578-gl33-hIgG1Lambda | LCDR2 | DNA | SEQ ID NO:469 |
| TPP-19546 | 17578-gl33-hIgG1Lambda | LCDR3 | DNA | SEQ ID NO:470 |
| TPP-19546 | 17578-gl33-hIgG1Lambda | HC | PRT | SEQ ID NO:471 |
| TPP-19546 | 17578-gl33-hIgG1Lambda | LC | PRT | SEQ ID NO:472 |
| TPP-20950 | 18206-gl-42-hIgG1wt-Lambda | VH | PRT | SEQ ID NO:473 |
| TPP-20950 | 18206-gl-42-hIgG1wt-Lambda | HCDR1 | PRT | SEQ ID NO:474 |
| TPP-20950 | 18206-gl-42-hIgG1wt-Lambda | HCDR2 | PRT | SEQ ID NO:475 |
| TPP-20950 | 18206-gl-42-hIgG1wt-Lambda | HCDR3 | PRT | SEQ ID NO:476 |
| TPP-20950 | 18206-gl-42-hIgG1wt-Lambda | VL | PRT | SEQ ID NO:477 |
| TPP-20950 | 18206-gl-42-hIgG1wt-Lambda | LCDR1 | PRT | SEQ ID NO:478 |
| TPP-20950 | 18206-gl-42-hIgG1wt-Lambda | LCDR2 | PRT | SEQ ID NO:479 |
| TPP-20950 | 18206-gl-42-hIgG1wt-Lambda | LCDR3 | PRT | SEQ ID NO:480 |
| TPP-20950 | 18206-gl-42-hIgG1wt-Lambda | VH | DNA | SEQ ID NO:481 |
| TPP-20950 | 18206-gl-42-hIgG1wt-Lambda | HCDR1 | DNA | SEQ ID NO:482 |
| TPP-20950 | 18206-gl-42-hIgG1wt-Lambda | HCDR2 | DNA | SEQ ID NO:483 |
| TPP-20950 | 18206-gl-42-hIgG1wt-Lambda | HCDR3 | DNA | SEQ ID NO:484 |
| TPP-20950 | 18206-gl-42-hIgG1wt-Lambda | VL | DNA | SEQ ID NO:485 |
| TPP-20950 | 18206-gl-42-hIgG1wt-Lambda | LCDR1 | DNA | SEQ ID NO:486 |
| TPP-20950 | 18206-gl-42-hIgG1wt-Lambda | LCDR2 | DNA | SEQ ID NO:487 |
| TPP-20950 | 18206-gl-42-hIgG1wt-Lambda | LCDR3 | DNA | SEQ ID NO:488 |
| TPP-20950 | 18206-gl-42-hIgG1wt-Lambda | HC | PRT | SEQ ID NO:489 |
| TPP-20950 | 18206-gl-42-hIgG1wt-Lambda | LC | PRT | SEQ ID NO:490 |
| TPP-20955 | 18206-gl-47-hIgG1wt-Lambda | VH | PRT | SEQ ID NO:491 |
| TPP-20955 | 18206-gl-47-hIgG1wt-Lambda | HCDR1 | PRT | SEQ ID NO:492 |
| TPP-20955 | 18206-gl-47-hIgG1wt-Lambda | HCDR2 | PRT | SEQ ID NO:493 |
| TPP-20955 | 18206-gl-47-hIgG1wt-Lambda | HCDR3 | PRT | SEQ ID NO:494 |
| TPP-20955 | 18206-gl-47-hIgG1wt-Lambda | VL | PRT | SEQ ID NO:495 |
| TPP-20955 | 18206-gl-47-hIgG1wt-Lambda | LCDR1 | PRT | SEQ ID NO:496 |
| TPP-20955 | 18206-gl-47-hIgG1wt-Lambda | LCDR2 | PRT | SEQ ID NO:497 |
| TPP-20955 | 18206-gl-47-hIgG1wt-Lambda | LCDR3 | PRT | SEQ ID NO:498 |
| TPP-20955 | 18206-gl-47-hIgG1wt-Lambda | VH | DNA | SEQ ID NO:499 |
| TPP-20955 | 18206-gl-47-hIgG1wt-Lambda | HCDR1 | DNA | SEQ ID NO:500 |
| TPP-20955 | 18206-gl-47-hIgG1wt-Lambda | HCDR2 | DNA | SEQ ID NO:501 |
| TPP-20955 | 18206-gl-47-hIgG1wt-Lambda | HCDR3 | DNA | SEQ ID NO:502 |
| TPP-20955 | 18206-gl-47-hIgG1wt-Lambda | VL | DNA | SEQ ID NO:503 |
| TPP-20955 | 18206-gl-47-hIgG1wt-Lambda | LCDR1 | DNA | SEQ ID NO:504 |
| TPP-20955 | 18206-gl-47-hIgG1wt-Lambda | LCDR2 | DNA | SEQ ID NO:505 |
| TPP-20955 | 18206-gl-47-hIgG1wt-Lambda | LCDR3 | DNA | SEQ ID NO:506 |
| TPP-20955 | 18206-gl-47-hIgG1wt-Lambda | HC | PRT | SEQ ID NO:507 |
| TPP-20955 | 18206-gl-47-hIgG1wt-Lambda | LC | PRT | SEQ ID NO:508 |
| TPP-20965 | 18206-gl-58-hIgG1wt-Lambda | VH | PRT | SEQ ID NO:509 |
| TPP-20965 | 18206-gl-58-hIgG1wt-Lambda | HCDR1 | PRT | SEQ ID NO:510 |

-continued

| TPP ID | Sequence Name | Sequence Region | Type | SEQ ID |
|---|---|---|---|---|
| TPP-20965 | 18206-gl-58-hIgG1wt-Lambda | HCDR2 | PRT | SEQ ID NO:511 |
| TPP-20965 | 18206-gl-58-hIgG1wt-Lambda | HCDR3 | PRT | SEQ ID NO:512 |
| TPP-20965 | 18206-gl-58-hIgG1wt-Lambda | VL | PRT | SEQ ID NO:513 |
| TPP-20965 | 18206-gl-58-hIgG1wt-Lambda | LCDR1 | PRT | SEQ ID NO:514 |
| TPP-20965 | 18206-gl-58-hIgG1wt-Lambda | LCDR2 | PRT | SEQ ID NO:515 |
| TPP-20965 | 18206-gl-58-hIgG1wt-Lambda | LCDR3 | PRT | SEQ ID NO:516 |
| TPP-20965 | 18206-gl-58-hIgG1wt-Lambda | VH | DNA | SEQ ID NO:517 |
| TPP-20965 | 18206-gl-58-hIgG1wt-Lambda | HCDR1 | DNA | SEQ ID NO:518 |
| TPP-20965 | 18206-gl-58-hIgG1wt-Lambda | HCDR2 | DNA | SEQ ID NO:519 |
| TPP-20965 | 18206-gl-58-hIgG1wt-Lambda | HCDR3 | DNA | SEQ ID NO:520 |
| TPP-20965 | 18206-gl-58-hIgG1wt-Lambda | VL | DNA | SEQ ID NO:521 |
| TPP-20965 | 18206-gl-58-hIgG1wt-Lambda | LCDR1 | DNA | SEQ ID NO:522 |
| TPP-20965 | 18206-gl-58-hIgG1wt-Lambda | LCDR2 | DNA | SEQ ID NO:523 |
| TPP-20965 | 18206-gl-58-hIgG1wt-Lambda | LCDR3 | DNA | SEQ ID NO:524 |
| TPP-20965 | 18206-gl-58-hIgG1wt-Lambda | HC | PRT | SEQ ID NO:525 |
| TPP-20965 | 18206-gl-58-hIgG1wt-Lambda | LC | PRT | SEQ ID NO:526 |
| TPP-21045 | 17578-gl79-hIgG1-wt-Lambda | VH | PRT | SEQ ID NO:527 |
| TPP-21045 | 17578-gl79-hIgG1-wt-Lambda | HCDR1 | PRT | SEQ ID NO:528 |
| TPP-21045 | 17578-gl79-hIgG1-wt-Lambda | HCDR2 | PRT | SEQ ID NO:529 |
| TPP-21045 | 17578-gl79-hIgG1-wt-Lambda | HCDR3 | PRT | SEQ ID NO:530 |
| TPP-21045 | 17578-gl79-hIgG1-wt-Lambda | VL | PRT | SEQ ID NO:531 |
| TPP-21045 | 17578-gl79-hIgG1-wt-Lambda | LCDR1 | PRT | SEQ ID NO:532 |
| TPP-21045 | 17578-gl79-hIgG1-wt-Lambda | LCDR2 | PRT | SEQ ID NO:533 |
| TPP-21045 | 17578-gl79-hIgG1-wt-Lambda | LCDR3 | PRT | SEQ ID NO:534 |
| TPP-21045 | 17578-gl79-hIgG1-wt-Lambda | VH | DNA | SEQ ID NO:535 |
| TPP-21045 | 17578-gl79-hIgG1-wt-Lambda | HCDR1 | DNA | SEQ ID NO:536 |
| TPP-21045 | 17578-gl79-hIgG1-wt-Lambda | HCDR2 | DNA | SEQ ID NO:537 |
| TPP-21045 | 17578-gl79-hIgG1-wt-Lambda | HCDR3 | DNA | SEQ ID NO:538 |
| TPP-21045 | 17578-gl79-hIgG1-wt-Lambda | VL | DNA | SEQ ID NO:539 |
| TPP-21045 | 17578-gl79-hIgG1-wt-Lambda | LCDR1 | DNA | SEQ ID NO:540 |
| TPP-21045 | 17578-gl79-hIgG1-wt-Lambda | LCDR2 | DNA | SEQ ID NO:541 |
| TPP-21045 | 17578-gl79-hIgG1-wt-Lambda | LCDR3 | DNA | SEQ ID NO:542 |
| TPP-21045 | 17578-gl79-hIgG1-wt-Lambda | HC | PRT | SEQ ID NO:543 |
| TPP-21045 | 17578-gl79-hIgG1-wt-Lambda | LC | PRT | SEQ ID NO:544 |
| TPP-21047 | 17578-gl81-hIgG1-wt-Lambda | VH | PRT | SEQ ID NO:545 |
| TPP-21047 | 17578-gl81-hIgG1-wt-Lambda | HCDR1 | PRT | SEQ ID NO:546 |
| TPP-21047 | 17578-gl81-hIgG1-wt-Lambda | HCDR2 | PRT | SEQ ID NO:547 |
| TPP-21047 | 17578-gl81-hIgG1-wt-Lambda | HCDR3 | PRT | SEQ ID NO:548 |
| TPP-21047 | 17578-gl81-hIgG1-wt-Lambda | VL | PRT | SEQ ID NO:549 |
| TPP-21047 | 17578-gl81-hIgG1-wt-Lambda | LCDR1 | PRT | SEQ ID NO:550 |
| TPP-21047 | 17578-gl81-hIgG1-wt-Lambda | LCDR2 | PRT | SEQ ID NO: 551 |
| TPP-21047 | 17578-gl81-hIgG1-wt-Lambda | LCDR3 | PRT | SEQ ID NO:552 |
| TPP-21047 | 17578-gl81-hIgG1-wt-Lambda | VH | DNA | SEQ ID NO:553 |
| TPP-21047 | 17578-gl81-hIgG1-wt-Lambda | HCDR1 | DNA | SEQ ID NO:554 |
| TPP-21047 | 17578-gl81-hIgG1-wt-Lambda | HCDR2 | DNA | SEQ ID NO:555 |
| TPP-21047 | 17578-gl81-hIgG1-wt-Lambda | HCDR3 | DNA | SEQ ID NO:556 |
| TPP-21047 | 17578-gl81-hIgG1-wt-Lambda | VL | DNA | SEQ ID NO:557 |
| TPP-21047 | 17578-gl81-hIgG1-wt-Lambda | LCDR1 | DNA | SEQ ID NO:558 |
| TPP-21047 | 17578-gl81-hIgG1-wt-Lambda | LCDR2 | DNA | SEQ ID NO:559 |
| TPP-21047 | 17578-gl81-hIgG1-wt-Lambda | LCDR3 | DNA | SEQ ID NO:560 |
| TPP-21047 | 17578-gl81-hIgG1-wt-Lambda | HC | PRT | SEQ ID NO:561 |
| TPP-21047 | 17578-gl81-hIgG1-wt-Lambda | LC | PRT | SEQ ID NO:562 |
| TPP-21181 | 18205-gl46-hIgG1-wt-Lambda | VH | PRT | SEQ ID NO:563 |
| TPP-21181 | 18205-gl46-hIgG1-wt-Lambda | HCDR1 | PRT | SEQ ID NO:564 |
| TPP-21181 | 18205-gl46-hIgG1-wt-Lambda | HCDR2 | PRT | SEQ ID NO:565 |
| TPP-21181 | 18205-gl46-hIgG1-wt-Lambda | HCDR3 | PRT | SEQ ID NO:566 |
| TPP-21181 | 18205-gl46-hIgG1-wt-Lambda | VL | PRT | SEQ ID NO:567 |
| TPP-21181 | 18205-gl46-hIgG1-wt-Lambda | LCDR1 | PRT | SEQ ID NO:568 |
| TPP-21181 | 18205-gl46-hIgG1-wt-Lambda | LCDR2 | PRT | SEQ ID NO:569 |
| TPP-21181 | 18205-gl46-hIgG1-wt-Lambda | LCDR3 | PRT | SEQ ID NO:570 |
| TPP-21181 | 18205-gl46-hIgG1-wt-Lambda | VH | DNA | SEQ ID NO:571 |
| TPP-21181 | 18205-gl46-hIgG1-wt-Lambda | HCDR1 | DNA | SEQ ID NO:572 |
| TPP-21181 | 18205-gl46-hIgG1-wt-Lambda | HCDR2 | DNA | SEQ ID NO:573 |
| TPP-21181 | 18205-gl46-hIgG1-wt-Lambda | HCDR3 | DNA | SEQ ID NO:574 |
| TPP-21181 | 18205-gl46-hIgG1-wt-Lambda | VL | DNA | SEQ ID NO:575 |
| TPP-21181 | 18205-gl46-hIgG1-wt-Lambda | LCDR1 | DNA | SEQ ID NO:576 |
| TPP-21181 | 18205-gl46-hIgG1-wt-Lambda | LCDR2 | DNA | SEQ ID NO:577 |
| TPP-21181 | 18205-gl46-hIgG1-wt-Lambda | LCDR3 | DNA | SEQ ID NO:578 |
| TPP-21181 | 18205-gl46-hIgG1-wt-Lambda | HC | PRT | SEQ ID NO:579 |
| TPP-21181 | 18205-gl46-hIgG1-wt-Lambda | LC | PRT | SEQ ID NO:580 |
| TPP-21183 | 18205-gl48-hIgG1-wt-Lambda | VH | PRT | SEQ ID NO:581 |
| TPP-21183 | 18205-gl48-hIgG1-wt-Lambda | HCDR1 | PRT | SEQ ID NO:582 |
| TPP-21183 | 18205-gl48-hIgG1-wt-Lambda | HCDR2 | PRT | SEQ ID NO:583 |
| TPP-21183 | 18205-gl48-hIgG1-wt-Lambda | HCDR3 | PRT | SEQ ID NO:584 |
| TPP-21183 | 18205-gl48-hIgG1-wt-Lambda | VL | PRT | SEQ ID NO:585 |
| TPP-21183 | 18205-gl48-hIgG1-wt-Lambda | LCDR1 | PRT | SEQ ID NO:586 |

-continued

| TPP ID | Sequence Name | Sequence Region | Type | SEQ ID |
|---|---|---|---|---|
| TPP-21183 | 18205-gl48-hIgG1-wt-Lambda | LCDR2 | PRT | SEQ ID NO:587 |
| TPP-21183 | 18205-gl48-hIgG1-wt-Lambda | LCDR3 | PRT | SEQ ID NO:588 |
| TPP-21183 | 18205-gl48-hIgG1-wt-Lambda | VH | DNA | SEQ ID NO:589 |
| TPP-21183 | 18205-gl48-hIgG1-wt-Lambda | HCDR1 | DNA | SEQ ID NO:590 |
| TPP-21183 | 18205-gl48-hIgG1-wt-Lambda | HCDR2 | DNA | SEQ ID NO:591 |
| TPP-21183 | 18205-gl48-hIgG1-wt-Lambda | HCDR3 | DNA | SEQ ID NO:592 |
| TPP-21183 | 18205-gl48-hIgG1-wt-Lambda | VL | DNA | SEQ ID NO:593 |
| TPP-21183 | 18205-gl48-hIgG1-wt-Lambda | LCDR1 | DNA | SEQ ID NO:594 |
| TPP-21183 | 18205-gl48-hIgG1-wt-Lambda | LCDR2 | DNA | SEQ ID NO:595 |
| TPP-21183 | 18205-gl48-hIgG1-wt-Lambda | LCDR3 | DNA | SEQ ID NO:596 |
| TPP-21183 | 18205-gl48-hIgG1-wt-Lambda | HC | PRT | SEQ ID NO:597 |
| TPP-21183 | 18205-gl48-hIgG1-wt-Lambda | LC | PRT | SEQ ID NO:598 |
| TPP-21360 | 18206-gl25-gl13-hIgG1Lambda | VH | PRT | SEQ ID NO:599 |
| TPP-21360 | 18206-gl25-gl13-hIgG1Lambda | HCDR1 | PRT | SEQ ID NO:600 |
| TPP-21360 | 18206-gl25-gl13-hIgG1Lambda | HCDR2 | PRT | SEQ ID NO:601 |
| TPP-21360 | 18206-gl25-gl13-hIgG1Lambda | HCDR3 | PRT | SEQ ID NO:602 |
| TPP-21360 | 18206-gl25-gl13-hIgG1Lambda | VL | PRT | SEQ ID NO:603 |
| TPP-21360 | 18206-gl25-gl13-hIgG1Lambda | LCDR1 | PRT | SEQ ID NO:604 |
| TPP-21360 | 18206-gl25-gl13-hIgG1Lambda | LCDR2 | PRT | SEQ ID NO:605 |
| TPP-21360 | 18206-gl25-gl13-hIgG1Lambda | LCDR3 | PRT | SEQ ID NO:606 |
| TPP-21360 | 18206-gl25-gl13-hIgG1Lambda | VH | DNA | SEQ ID NO:607 |
| TPP-21360 | 18206-gl25-gl13-hIgG1Lambda | HCDR1 | DNA | SEQ ID NO:608 |
| TPP-21360 | 18206-gl25-gl13-hIgG1Lambda | HCDR2 | DNA | SEQ ID NO:609 |
| TPP-21360 | 18206-gl25-gl13-hIgG1Lambda | HCDR3 | DNA | SEQ ID NO:610 |
| TPP-21360 | 18206-gl25-gl13-hIgG1Lambda | VL | DNA | SEQ ID NO:611 |
| TPP-21360 | 18206-gl25-gl13-hIgG1Lambda | LCDR1 | DNA | SEQ ID NO:612 |
| TPP-21360 | 18206-gl25-gl13-hIgG1Lambda | LCDR2 | DNA | SEQ ID NO:613 |
| TPP-21360 | 18206-gl25-gl13-hIgG1Lambda | LCDR3 | DNA | SEQ ID NO:614 |
| TPP-21360 | 18206-gl25-gl13-hIgG1Lambda | HC | PRT | SEQ ID NO:615 |
| TPP-21360 | 18206-gl25-gl13-hIgG1Lambda | LC | PRT | SEQ ID NO:616 |
| TPP-23411 | 21360-hIgG1wtlambda | VH | PRT | SEQ ID NO:617 |
| TPP-23411 | 21360-hIgG1wtlambda | HCDR1 | PRT | SEQ ID NO:618 |
| TPP-23411 | 21360-hIgG1wtlambda | HCDR2 | PRT | SEQ ID NO:619 |
| TPP-23411 | 21360-hIgG1wtlambda | HCDR3 | PRT | SEQ ID NO:620 |
| TPP-23411 | 21360-hIgG1wtlambda | VL | PRT | SEQ ID NO:621 |
| TPP-23411 | 21360-hIgG1wtlambda | LCDR1 | PRT | SEQ ID NO:622 |
| TPP-23411 | 21360-hIgG1wtlambda | LCDR2 | PRT | SEQ ID NO:623 |
| TPP-23411 | 21360-hIgG1wtlambda | LCDR3 | PRT | SEQ ID NO:624 |
| TPP-23411 | 21360-hIgG1wtlambda | VH | DNA | SEQ ID NO:625 |
| TPP-23411 | 21360-hIgG1wtlambda | HCDR1 | DNA | SEQ ID NO:626 |
| TPP-23411 | 21360-hIgG1wtlambda | HCDR2 | DNA | SEQ ID NO:627 |
| TPP-23411 | 21360-hIgG1wtlambda | HCDR3 | DNA | SEQ ID NO:628 |
| TPP-23411 | 21360-hIgG1wtlambda | VL | DNA | SEQ ID NO:629 |
| TPP-23411 | 21360-hIgG1wtlambda | LCDR1 | DNA | SEQ ID NO:630 |
| TPP-23411 | 21360-hIgG1wtlambda | LCDR2 | DNA | SEQ ID NO:631 |
| TPP-23411 | 21360-hIgG1wtlambda | LCDR3 | DNA | SEQ ID NO:632 |
| TPP-23411 | 21360-hIgG1wtlambda | HC | PRT | SEQ ID NO:633 |
| TPP-23411 | 21360-hIgG1wtlambda | LC | PRT | SEQ ID NO:634 |
| TPP-29596 | 18206-gl13-gl14-hIgG1wtLambda | VH | PRT | SEQ ID NO:660 |
| TPP-29596 | 18206-gl13-gl14-hIgG1wtLambda | HCDR1 | PRT | SEQ ID NO:661 |
| TPP-29596 | 18206-gl13-gl14-hIgG1wtLambda | HCDR2 | PRT | SEQ ID NO:662 |
| TPP-29596 | 18206-gl13-gl14-hIgG1wtLambda | HCDR3 | PRT | SEQ ID NO:663 |
| TPP-29596 | 18206-gl13-gl14-hIgG1wtLambda | VL | PRT | SEQ ID NO:664 |
| TPP-29596 | 18206-gl13-gl14-hIgG1wtLambda | LCDR1 | PRT | SEQ ID NO:665 |
| TPP-29596 | 18206-gl13-gl14-hIgG1wtLambda | LCDR2 | PRT | SEQ ID NO:666 |
| TPP-29596 | 18206-gl13-gl14-hIgG1wtLambda | LCDR3 | PRT | SEQ ID NO:667 |
| TPP-29596 | 18206-gl13-gl14-hIgG1wtLambda | VH | DNA | SEQ ID NO:668 |
| TPP-29596 | 18206-gl13-gl14-hIgG1wtLambda | HCDR1 | DNA | SEQ ID NO:669 |
| TPP-29596 | 18206-gl13-gl14-hIgG1wtLambda | HCDR2 | DNA | SEQ ID NO:670 |
| TPP-29596 | 18206-gl13-gl14-hIgG1wtLambda | HCDR3 | DNA | SEQ ID NO:671 |
| TPP-29596 | 18206-gl13-gl14-hIgG1wtLambda | VL | DNA | SEQ ID NO:672 |
| TPP-29596 | 18206-gl13-gl14-hIgG1wtLambda | LCDR1 | DNA | SEQ ID NO:673 |
| TPP-29596 | 18206-gl13-gl14-hIgG1wtLambda | LCDR2 | DNA | SEQ ID NO:674 |
| TPP-29596 | 18206-gl13-gl14-hIgG1wtLambda | LCDR3 | DNA | SEQ ID NO:675 |
| TPP-29596 | 18206-gl13-gl14-hIgG1wtLambda | HC | PRT | SEQ ID NO:676 |
| TPP-29596 | 18206-gl13-gl14-hIgG1wtLambda | LC | PRT | SEQ ID NO:677 |
| TPP-29596 | 18206-gl13-gl14-hIgG1wtLambda | HC | DNA | SEQ ID NO:678 |
| TPP-29596 | 18206-gl13-gl14-hIgG1wtLambda | LC | DNA | SEQ ID NO:679 |
| TPP-29597 | 18206-gl11-gl25-hIgG1wtLambda | VH | PRT | SEQ ID NO:680 |
| TPP-29597 | 18206-gl11-gl25-hIgG1wtLambda | HCDR1 | PRT | SEQ ID NO:681 |
| TPP-29597 | 18206-gl11-gl25-hIgG1wtLambda | HCDR2 | PRT | SEQ ID NO:682 |
| TPP-29597 | 18206-gl11-gl25-hIgG1wtLambda | HCDR3 | PRT | SEQ ID NO:683 |
| TPP-29597 | 18206-gl11-gl25-hIgG1wtLambda | VL | PRT | SEQ ID NO:684 |
| TPP-29597 | 18206-gl11-gl25-hIgG1wtLambda | LCDR1 | PRT | SEQ ID NO:685 |
| TPP-29597 | 18206-gl11-gl25-hIgG1wtLambda | LCDR2 | PRT | SEQ ID NO:686 |
| TPP-29597 | 18206-gl11-gl25-hIgG1wtLambda | LCDR3 | PRT | SEQ ID NO:687 |

-continued

| TPP ID | Sequence Name | Sequence Region | Type | SEQ ID |
|---|---|---|---|---|
| TPP-29597 | 18206-gl11-gl25-hIgG1wtLambda | VH | DNA | SEQ ID NO:688 |
| TPP-29597 | 18206-gl11-gl25-hIgG1wtLambda | HCDR1 | DNA | SEQ ID NO:689 |
| TPP-29597 | 18206-gl11-gl25-hIgG1wtLambda | HCDR2 | DNA | SEQ ID NO:690 |
| TPP-29597 | 18206-gl11-gl25-hIgG1wtLambda | HCDR3 | DNA | SEQ ID NO:691 |
| TPP-29597 | 18206-gl11-gl25-hIgG1wtLambda | VL | DNA | SEQ ID NO:692 |
| TPP-29597 | 18206-gl11-gl25-hIgG1wtLambda | LCDR1 | DNA | SEQ ID NO:693 |
| TPP-29597 | 18206-gl11-gl25-hIgG1wtLambda | LCDR2 | DNA | SEQ ID NO:694 |
| TPP-29597 | 18206-gl11-gl25-hIgG1wtLambda | LCDR3 | DNA | SEQ ID NO:695 |
| TPP-29597 | 18206-gl11-gl25-hIgG1wtLambda | HC | PRT | SEQ ID NO:696 |
| TPP-29597 | 18206-gl11-gl25-hIgG1wtLambda | LC | PRT | SEQ ID NO:697 |
| TPP-29597 | 18206-gl11-gl25-hIgG1wtLambda | HC | DNA | SEQ ID NO:698 |
| TPP-29597 | 18206-gl11-gl25-hIgG1wtLambda | LC | DNA | SEQ ID NO:699 |
| TPP-18206 | 002-F01_497A-M281-P02+497A-M317-O07-hIgG1Lambda | HC | DNA | SEQ ID NO:700 |
| TPP-18206 | 002-F01_497A-M281-P02+497A-M317-O07-hIgG1Lambda | LC | DNA | SEQ ID NO:701 |
| TPP-18429 | 18206-gl10-hIgG1Lambda | VH | PRT | SEQ ID NO:702 |
| TPP-18429 | 18206-gl10-hIgG1Lambda | HCDR1 | PRT | SEQ ID NO:703 |
| TPP-18429 | 18206-gl10-hIgG1Lambda | HCDR2 | PRT | SEQ ID NO:704 |
| TPP-18429 | 18206-gl10-hIgG1Lambda | HCDR3 | PRT | SEQ ID NO:705 |
| TPP-18429 | 18206-gl10-hIgG1Lambda | VL | PRT | SEQ ID NO:706 |
| TPP-18429 | 18206-gl10-hIgG1Lambda | LCDR1 | PRT | SEQ ID NO:707 |
| TPP-18429 | 18206-gl10-hIgG1Lambda | LCDR2 | PRT | SEQ ID NO:708 |
| TPP-18429 | 18206-gl10-hIgG1Lambda | LCDR3 | PRT | SEQ ID NO:709 |
| TPP-18429 | 18206-gl10-hIgG1Lambda | VH | DNA | SEQ ID NO:710 |
| TPP-18429 | 18206-gl10-hIgG1Lambda | HCDR1 | DNA | SEQ ID NO:711 |
| TPP-18429 | 18206-gl10-hIgG1Lambda | HCDR2 | DNA | SEQ ID NO:712 |
| TPP-18429 | 18206-gl10-hIgG1Lambda | HCDR3 | DNA | SEQ ID NO:713 |
| TPP-18429 | 18206-gl10-hIgG1Lambda | VL | DNA | SEQ ID NO:714 |
| TPP-18429 | 18206-gl10-hIgG1Lambda | LCDR1 | DNA | SEQ ID NO:715 |
| TPP-18429 | 18206-gl10-hIgG1Lambda | LCDR2 | DNA | SEQ ID NO:716 |
| TPP-18429 | 18206-gl10-hIgG1Lambda | LCDR3 | DNA | SEQ ID NO:717 |
| TPP-18429 | 18206-gl10-hIgG1Lambda | HC | PRT | SEQ ID NO:718 |
| TPP-18429 | 18206-gl10-hIgG1Lambda | LC | PRT | SEQ ID NO:719 |
| TPP-18429 | 18206-gl10-hIgG1Lambda | HC | DNA | SEQ ID NO:720 |
| TPP-18429 | 18206-gl10-hIgG1Lambda | LC | DNA | SEQ ID NO:721 |
| TPP-18430 | 18206-gl11-hIgG1Lambda | VH | PRT | SEQ ID NO:722 |
| TPP-18430 | 18206-gl11-hIgG1Lambda | HCDR1 | PRT | SEQ ID NO:723 |
| TPP-18430 | 18206-gl11-hIgG1Lambda | HCDR2 | PRT | SEQ ID NO:724 |
| TPP-18430 | 18206-gl11-hIgG1Lambda | HCDR3 | PRT | SEQ ID NO:725 |
| TPP-18430 | 18206-gl11-hIgG1Lambda | VL | PRT | SEQ ID NO:726 |
| TPP-18430 | 18206-gl11-hIgG1Lambda | LCDR1 | PRT | SEQ ID NO:727 |
| TPP-18430 | 18206-gl11-hIgG1Lambda | LCDR2 | PRT | SEQ ID NO:728 |
| TPP-18430 | 18206-gl11-hIgG1Lambda | LCDR3 | PRT | SEQ ID NO:729 |
| TPP-18430 | 18206-gl11-hIgG1Lambda | VH | DNA | SEQ ID NO:730 |
| TPP-18430 | 18206-gl11-hIgG1Lambda | HCDR1 | DNA | SEQ ID NO:731 |
| TPP-18430 | 18206-gl11-hIgG1Lambda | HCDR2 | DNA | SEQ ID NO:732 |
| TPP-18430 | 18206-gl11-hIgG1Lambda | HCDR3 | DNA | SEQ ID NO:733 |
| TPP-18430 | 18206-gl11-hIgG1Lambda | VL | DNA | SEQ ID NO:734 |
| TPP-18430 | 18206-gl11-hIgG1Lambda | LCDR1 | DNA | SEQ ID NO:735 |
| TPP-18430 | 18206-gl11-hIgG1Lambda | LCDR2 | DNA | SEQ ID NO:736 |
| TPP-18430 | 18206-gl11-hIgG1Lambda | LCDR3 | DNA | SEQ ID NO:737 |
| TPP-18430 | 18206-gl11-hIgG1Lambda | HC | PRT | SEQ ID NO:738 |
| TPP-18430 | 18206-gl11-hIgG1Lambda | LC | PRT | SEQ ID NO:739 |
| TPP-18430 | 18206-gl11-hIgG1Lambda | HC | DNA | SEQ ID NO:740 |
| TPP-18430 | 18206-gl11-hIgG1Lambda | LC | DNA | SEQ ID NO:741 |
| TPP-18432 | 18206-gl13-hIgG1Lambda | VH | PRT | SEQ ID NO:742 |
| TPP-18432 | 18206-gl13-hIgG1Lambda | HCDR1 | PRT | SEQ ID NO:743 |
| TPP-18432 | 18206-gl13-hIgG1Lambda | HCDR2 | PRT | SEQ ID NO:744 |
| TPP-18432 | 18206-gl13-hIgG1Lambda | HCDR3 | PRT | SEQ ID NO:745 |
| TPP-18432 | 18206-gl13-hIgG1Lambda | VL | PRT | SEQ ID NO:746 |
| TPP-18432 | 18206-gl13-hIgG1Lambda | LCDR1 | PRT | SEQ ID NO:747 |
| TPP-18432 | 18206-gl13-hIgG1Lambda | LCDR2 | PRT | SEQ ID NO:748 |
| TPP-18432 | 18206-gl13-hIgG1Lambda | LCDR3 | PRT | SEQ ID NO:749 |
| TPP-18432 | 18206-gl13-hIgG1Lambda | VH | DNA | SEQ ID NO:750 |
| TPP-18432 | 18206-gl13-hIgG1Lambda | HCDR1 | DNA | SEQ ID NO:751 |
| TPP-18432 | 18206-gl13-hIgG1Lambda | HCDR2 | DNA | SEQ ID NO:752 |
| TPP-18432 | 18206-gl13-hIgG1Lambda | HCDR3 | DNA | SEQ ID NO:753 |
| TPP-18432 | 18206-gl13-hIgG1Lambda | VL | DNA | SEQ ID NO:754 |
| TPP-18432 | 18206-gl13-hIgG1Lambda | LCDR1 | DNA | SEQ ID NO:755 |
| TPP-18432 | 18206-gl13-hIgG1Lambda | LCDR2 | DNA | SEQ ID NO:756 |
| TPP-18432 | 18206-gl13-hIgG1Lambda | LCDR3 | DNA | SEQ ID NO:757 |
| TPP-18432 | 18206-gl13-hIgG1Lambda | HC | PRT | SEQ ID NO:758 |
| TPP-18432 | 18206-gl13-hIgG1Lambda | LC | PRT | SEQ ID NO:759 |
| TPP-18432 | 18206-gl13-hIgG1Lambda | HC | DNA | SEQ ID NO:760 |
| TPP-18432 | 18206-gl13-hIgG1Lambda | LC | DNA | SEQ ID NO:761 |

-continued

| TPP ID | Sequence Name | Sequence Region | Type | SEQ ID |
|---|---|---|---|---|
| TPP-18433 | 18206-gl14-hIgG1Lambda | VH | PRT | SEQ ID NO:762 |
| TPP-18433 | 18206-gl14-hIgG1Lambda | HCDR1 | PRT | SEQ ID NO:763 |
| TPP-18433 | 18206-gl14-hIgG1Lambda | HCDR2 | PRT | SEQ ID NO:764 |
| TPP-18433 | 18206-gl14-hIgG1Lambda | HCDR3 | PRT | SEQ ID NO:765 |
| TPP-18433 | 18206-gl14-hIgG1Lambda | VL | PRT | SEQ ID NO:766 |
| TPP-18433 | 18206-gl14-hIgG1Lambda | LCDR1 | PRT | SEQ ID NO:767 |
| TPP-18433 | 18206-gl14-hIgG1Lambda | LCDR2 | PRT | SEQ ID NO:768 |
| TPP-18433 | 18206-gl14-hIgG1Lambda | LCDR3 | PRT | SEQ ID NO:769 |
| TPP-18433 | 18206-gl14-hIgG1Lambda | VH | DNA | SEQ ID NO:770 |
| TPP-18433 | 18206-gl14-hIgG1Lambda | HCDR1 | DNA | SEQ ID NO:771 |
| TPP-18433 | 18206-gl14-hIgG1Lambda | HCDR2 | DNA | SEQ ID NO:772 |
| TPP-18433 | 18206-gl14-hIgG1Lambda | HCDR3 | DNA | SEQ ID NO:773 |
| TPP-18433 | 18206-gl14-hIgG1Lambda | VL | DNA | SEQ ID NO:774 |
| TPP-18433 | 18206-gl14-hIgG1Lambda | LCDR1 | DNA | SEQ ID NO:775 |
| TPP-18433 | 18206-gl14-hIgG1Lambda | LCDR2 | DNA | SEQ ID NO:776 |
| TPP-18433 | 18206-gl14-hIgG1Lambda | LCDR3 | DNA | SEQ ID NO:777 |
| TPP-18433 | 18206-gl14-hIgG1Lambda | HC | PRT | SEQ ID NO:778 |
| TPP-18433 | 18206-gl14-hIgG1Lambda | LC | PRT | SEQ ID NO:779 |
| TPP-18433 | 18206-gl14-hIgG1Lambda | HC | DNA | SEQ ID NO:780 |
| TPP-18433 | 18206-gl14-hIgG1Lambda | LC | DNA | SEQ ID NO:781 |
| TPP-18436 | 18206-gl17-hIgG1Lambda | VH | PRT | SEQ ID NO:782 |
| TPP-18436 | 18206-gl17-hIgG1Lambda | HCDR1 | PRT | SEQ ID NO:783 |
| TPP-18436 | 18206-gl17-hIgG1Lambda | HCDR2 | PRT | SEQ ID NO:784 |
| TPP-18436 | 18206-gl17-hIgG1Lambda | HCDR3 | PRT | SEQ ID NO:785 |
| TPP-18436 | 18206-gl17-hIgG1Lambda | VL | PRT | SEQ ID NO:786 |
| TPP-18436 | 18206-gl17-hIgG1Lambda | LCDR1 | PRT | SEQ ID NO:787 |
| TPP-18436 | 18206-gl17-hIgG1Lambda | LCDR2 | PRT | SEQ ID NO:788 |
| TPP-18436 | 18206-gl17-hIgG1Lambda | LCDR3 | PRT | SEQ ID NO:789 |
| TPP-18436 | 18206-gl17-hIgG1Lambda | VH | DNA | SEQ ID NO:790 |
| TPP-18436 | 18206-gl17-hIgG1Lambda | HCDR1 | DNA | SEQ ID NO:791 |
| TPP-18436 | 18206-gl17-hIgG1Lambda | HCDR2 | DNA | SEQ ID NO:792 |
| TPP-18436 | 18206-gl17-hIgG1Lambda | HCDR3 | DNA | SEQ ID NO:793 |
| TPP-18436 | 18206-gl17-hIgG1Lambda | VL | DNA | SEQ ID NO:794 |
| TPP-18436 | 18206-gl17-hIgG1Lambda | LCDR1 | DNA | SEQ ID NO:795 |
| TPP-18436 | 18206-gl17-hIgG1Lambda | LCDR2 | DNA | SEQ ID NO:796 |
| TPP-18436 | 18206-gl17-hIgG1Lambda | LCDR3 | DNA | SEQ ID NO:797 |
| TPP-18436 | 18206-gl17-hIgG1Lambda | HC | PRT | SEQ ID NO:798 |
| TPP-18436 | 18206-gl17-hIgG1Lambda | LC | PRT | SEQ ID NO:799 |
| TPP-18436 | 18206-gl17-hIgG1Lambda | HC | DNA | SEQ ID NO:800 |
| TPP-18436 | 18206-gl17-hIgG1Lambda | LC | DNA | SEQ ID NO:801 |
| TPP-19571 | 18206-gl25-hIgG1Lambda | VH | PRT | SEQ ID NO:802 |
| TPP-19571 | 18206-gl25-hIgG1Lambda | HCDR1 | PRT | SEQ ID NO:803 |
| TPP-19571 | 18206-gl25-hIgG1Lambda | HCDR2 | PRT | SEQ ID NO:804 |
| TPP-19571 | 18206-gl25-hIgG1Lambda | HCDR3 | PRT | SEQ ID NO:805 |
| TPP-19571 | 18206-gl25-hIgG1Lambda | VL | PRT | SEQ ID NO:806 |
| TPP-19571 | 18206-gl25-hIgG1Lambda | LCDR1 | PRT | SEQ ID NO:807 |
| TPP-19571 | 18206-gl25-hIgG1Lambda | LCDR2 | PRT | SEQ ID NO:808 |
| TPP-19571 | 18206-gl25-hIgG1Lambda | LCDR3 | PRT | SEQ ID NO:809 |
| TPP-19571 | 18206-gl25-hIgG1Lambda | VH | DNA | SEQ ID NO:810 |
| TPP-19571 | 18206-gl25-hIgG1Lambda | HCDR1 | DNA | SEQ ID NO:811 |
| TPP-19571 | 18206-gl25-hIgG1Lambda | HCDR2 | DNA | SEQ ID NO:812 |
| TPP-19571 | 18206-gl25-hIgG1Lambda | HCDR3 | DNA | SEQ ID NO:813 |
| TPP-19571 | 18206-gl25-hIgG1Lambda | VL | DNA | SEQ ID NO:814 |
| TPP-19571 | 18206-gl25-hIgG1Lambda | LCDR1 | DNA | SEQ ID NO:815 |
| TPP-19571 | 18206-gl25-hIgG1Lambda | LCDR2 | DNA | SEQ ID NO:816 |
| TPP-19571 | 18206-gl25-hIgG1Lambda | LCDR3 | DNA | SEQ ID NO:817 |
| TPP-19571 | 18206-gl25-hIgG1Lambda | HC | PRT | SEQ ID NO:818 |
| TPP-19571 | 18206-gl25-hIgG1Lambda | LC | PRT | SEQ ID NO:819 |
| TPP-19571 | 18206-gl25-hIgG1Lambda | HC | DNA | SEQ ID NO:820 |
| TPP-19571 | 18206-gl25-hIgG1Lambda | LC | DNA | SEQ ID NO:821 |
| TPP-21360 | 18206-gl25-gl13-hIgG1Lambda | HC | DNA | SEQ ID NO:822 |
| TPP-21360 | 18206-gl25-gl13-hIgG1Lambda | LC | DNA | SEQ ID NO:823 |
| TPP-23411 | 21360-hIgG1lambda | HC | DNA | SEQ ID NO:824 |
| TPP-23411 | 21360-hIgG1lambda | LC | DNA | SEQ ID NO:825 |
| TPP-27477 | 18206-gl10-gl25-hIgG1Lambda | VH | PRT | SEQ ID NO:826 |
| TPP-27477 | 18206-gl10-gl25-hIgG1Lambda | HCDR1 | PRT | SEQ ID NO:827 |
| TPP-27477 | 18206-gl10-gl25-hIgG1Lambda | HCDR2 | PRT | SEQ ID NO:828 |
| TPP-27477 | 18206-gl10-gl25-hIgG1Lambda | HCDR3 | PRT | SEQ ID NO:829 |
| TPP-27477 | 18206-gl10-gl25-hIgG1Lambda | VL | PRT | SEQ ID NO:830 |
| TPP-27477 | 18206-gl10-gl25-hIgG1Lambda | LCDR1 | PRT | SEQ ID NO:831 |
| TPP-27477 | 18206-gl10-gl25-hIgG1Lambda | LCDR2 | PRT | SEQ ID NO:832 |
| TPP-27477 | 18206-gl10-gl25-hIgG1Lambda | LCDR3 | PRT | SEQ ID NO:833 |
| TPP-27477 | 18206-gl10-gl25-hIgG1Lambda | VH | DNA | SEQ ID NO:834 |
| TPP-27477 | 18206-gl10-gl25-hIgG1Lambda | HCDR1 | DNA | SEQ ID NO:835 |
| TPP-27477 | 18206-gl10-gl25-hIgG1Lambda | HCDR2 | DNA | SEQ ID NO:836 |
| TPP-27477 | 18206-gl10-gl25-hIgG1Lambda | HCDR3 | DNA | SEQ ID NO:837 |

-continued

| TPP ID | Sequence Name | Sequence Region | Type | SEQ ID |
|---|---|---|---|---|
| TPP-27477 | 18206-gl10-gl25-hIgG1Lambda | VL | DNA | SEQ ID NO:838 |
| TPP-27477 | 18206-gl10-gl25-hIgG1Lambda | LCDR1 | DNA | SEQ ID NO:839 |
| TPP-27477 | 18206-gl10-gl25-hIgG1Lambda | LCDR2 | DNA | SEQ ID NO:840 |
| TPP-27477 | 18206-gl10-gl25-hIgG1Lambda | LCDR3 | DNA | SEQ ID NO:841 |
| TPP-27477 | 18206-gl10-gl25-hIgG1Lambda | HC | PRT | SEQ ID NO:842 |
| TPP-27477 | 18206-gl10-gl25-hIgG1Lambda | LC | PRT | SEQ ID NO:843 |
| TPP-27477 | 18206-gl10-gl25-hIgG1Lambda | HC | DNA | SEQ ID NO:844 |
| TPP-27477 | 18206-gl10-gl25-hIgG1Lambda | LC | DNA | SEQ ID NO:845 |
| TPP-27478 | 18206-gl11-gl25-hIgG1Lambda | VH | PRT | SEQ ID NO:846 |
| TPP-27478 | 18206-gl11-gl25-hIgG1Lambda | HCDR1 | PRT | SEQ ID NO:847 |
| TPP-27478 | 18206-gl11-gl25-hIgG1Lambda | HCDR2 | PRT | SEQ ID NO:848 |
| TPP-27478 | 18206-gl11-gl25-hIgG1Lambda | HCDR3 | PRT | SEQ ID NO:849 |
| TPP-27478 | 18206-gl11-gl25-hIgG1Lambda | VL | PRT | SEQ ID NO:850 |
| TPP-27478 | 18206-gl11-gl25-hIgG1Lambda | LCDR1 | PRT | SEQ ID NO:851 |
| TPP-27478 | 18206-gl11-gl25-hIgG1Lambda | LCDR2 | PRT | SEQ ID NO:852 |
| TPP-27478 | 18206-gl11-gl25-hIgG1Lambda | LCDR3 | PRT | SEQ ID NO:853 |
| TPP-27478 | 18206-gl11-gl25-hIgG1Lambda | VH | DNA | SEQ ID NO:854 |
| TPP-27478 | 18206-gl11-gl25-hIgG1Lambda | HCDR1 | DNA | SEQ ID NO:855 |
| TPP-27478 | 18206-gl11-gl25-hIgG1Lambda | HCDR2 | DNA | SEQ ID NO:856 |
| TPP-27478 | 18206-gl11-gl25-hIgG1Lambda | HCDR3 | DNA | SEQ ID NO:857 |
| TPP-27478 | 18206-gl11-gl25-hIgG1Lambda | VL | DNA | SEQ ID NO:858 |
| TPP-27478 | 18206-gl11-gl25-hIgG1Lambda | LCDR1 | DNA | SEQ ID NO:859 |
| TPP-27478 | 18206-gl11-gl25-hIgG1Lambda | LCDR2 | DNA | SEQ ID NO:860 |
| TPP-27478 | 18206-gl11-gl25-hIgG1Lambda | LCDR3 | DNA | SEQ ID NO:861 |
| TPP-27478 | 18206-gl11-gl25-hIgG1Lambda | HC | PRT | SEQ ID NO:862 |
| TPP-27478 | 18206-gl11-gl25-hIgG1Lambda | LC | PRT | SEQ ID NO:863 |
| TPP-27478 | 18206-gl11-gl25-hIgG1Lambda | HC | DNA | SEQ ID NO:864 |
| TPP-27478 | 18206-gl11-gl25-hIgG1Lambda | LC | DNA | SEQ ID NO:865 |
| TPP-27479 | 18206-gl13-gl14-hIgG1Lambda | VH | PRT | SEQ ID NO:866 |
| TPP-27479 | 18206-gl13-gl14-hIgG1Lambda | HCDR1 | PRT | SEQ ID NO:867 |
| TPP-27479 | 18206-gl13-gl14-hIgG1Lambda | HCDR2 | PRT | SEQ ID NO:868 |
| TPP-27479 | 18206-gl13-gl14-hIgG1Lambda | HCDR3 | PRT | SEQ ID NO:869 |
| TPP-27479 | 18206-gl13-gl14-hIgG1Lambda | VL | PRT | SEQ ID NO:870 |
| TPP-27479 | 18206-gl13-gl14-hIgG1Lambda | LCDR1 | PRT | SEQ ID NO:871 |
| TPP-27479 | 18206-gl13-gl14-hIgG1Lambda | LCDR2 | PRT | SEQ ID NO:872 |
| TPP-27479 | 18206-gl13-gl14-hIgG1Lambda | LCDR3 | PRT | SEQ ID NO:873 |
| TPP-27479 | 18206-gl13-gl14-hIgG1Lambda | VH | DNA | SEQ ID NO:874 |
| TPP-27479 | 18206-gl13-gl14-hIgG1Lambda | HCDR1 | DNA | SEQ ID NO:875 |
| TPP-27479 | 18206-gl13-gl14-hIgG1Lambda | HCDR2 | DNA | SEQ ID NO:876 |
| TPP-27479 | 18206-gl13-gl14-hIgG1Lambda | HCDR3 | DNA | SEQ ID NO:877 |
| TPP-27479 | 18206-gl13-gl14-hIgG1Lambda | VL | DNA | SEQ ID NO:878 |
| TPP-27479 | 18206-gl13-gl14-hIgG1Lambda | LCDR1 | DNA | SEQ ID NO:879 |
| TPP-27479 | 18206-gl13-gl14-hIgG1Lambda | LCDR2 | DNA | SEQ ID NO:880 |
| TPP-27479 | 18206-gl13-gl14-hIgG1Lambda | LCDR3 | DNA | SEQ ID NO:881 |
| TPP-27479 | 18206-gl13-gl14-hIgG1Lambda | HC | PRT | SEQ ID NO:882 |
| TPP-27479 | 18206-gl13-gl14-hIgG1Lambda | LC | PRT | SEQ ID NO:883 |
| TPP-27479 | 18206-gl13-gl14-hIgG1Lambda | HC | DNA | SEQ ID NO:884 |
| TPP-27479 | 18206-gl13-gl14-hIgG1Lambda | LC | DNA | SEQ ID NO:885 |
| TPP-27480 | 18206-gl13-gl20-hIgG1Lambda | VH | PRT | SEQ ID NO:886 |
| TPP-27480 | 18206-gl13-gl20-hIgG1Lambda | HCDR1 | PRT | SEQ ID NO:887 |
| TPP-27480 | 18206-gl13-gl20-hIgG1Lambda | HCDR2 | PRT | SEQ ID NO:888 |
| TPP-27480 | 18206-gl13-gl20-hIgG1Lambda | HCDR3 | PRT | SEQ ID NO:889 |
| TPP-27480 | 18206-gl13-gl20-hIgG1Lambda | VL | PRT | SEQ ID NO:890 |
| TPP-27480 | 18206-gl13-gl20-hIgG1Lambda | LCDR1 | PRT | SEQ ID NO:891 |
| TPP-27480 | 18206-gl13-gl20-hIgG1Lambda | LCDR2 | PRT | SEQ ID NO:892 |
| TPP-27480 | 18206-gl13-gl20-hIgG1Lambda | LCDR3 | PRT | SEQ ID NO:893 |
| TPP-27480 | 18206-gl13-gl20-hIgG1Lambda | VH | DNA | SEQ ID NO:894 |
| TPP-27480 | 18206-gl13-gl20-hIgG1Lambda | HCDR1 | DNA | SEQ ID NO:895 |
| TPP-27480 | 18206-gl13-gl20-hIgG1Lambda | HCDR2 | DNA | SEQ ID NO:896 |
| TPP-27480 | 18206-gl13-gl20-hIgG1Lambda | HCDR3 | DNA | SEQ ID NO:897 |
| TPP-27480 | 18206-gl13-gl20-hIgG1Lambda | VL | DNA | SEQ ID NO:898 |
| TPP-27480 | 18206-gl13-gl20-hIgG1Lambda | LCDR1 | DNA | SEQ ID NO:899 |
| TPP-27480 | 18206-gl13-gl20-hIgG1Lambda | LCDR2 | DNA | SEQ ID NO:900 |
| TPP-27480 | 18206-gl13-gl20-hIgG1Lambda | LCDR3 | DNA | SEQ ID NO:901 |
| TPP-27480 | 18206-gl13-gl20-hIgG1Lambda | HC | PRT | SEQ ID NO:902 |
| TPP-27480 | 18206-gl13-gl20-hIgG1Lambda | LC | PRT | SEQ ID NO:903 |
| TPP-27480 | 18206-gl13-gl20-hIgG1Lambda | HC | DNA | SEQ ID NO:904 |
| TPP-27480 | 18206-gl13-gl20-hIgG1Lambda | LC | DNA | SEQ ID NO:905 |
| TPP-29367 | 18206-hIgG1wtLambda | VH | PRT | SEQ ID NO:906 |
| TPP-29367 | 18206-hIgG1wtLambda | HCDR1 | PRT | SEQ ID NO:907 |
| TPP-29367 | 18206-hIgG1wtLambda | HCDR2 | PRT | SEQ ID NO:908 |
| TPP-29367 | 18206-hIgG1wtLambda | HCDR3 | PRT | SEQ ID NO:909 |
| TPP-29367 | 18206-hIgG1wtLambda | VL | PRT | SEQ ID NO:910 |
| TPP-29367 | 18206-hIgG1wtLambda | LCDR1 | PRT | SEQ ID NO:911 |
| TPP-29367 | 18206-hIgG1wtLambda | LCDR2 | PRT | SEQ ID NO:912 |
| TPP-29367 | 18206-hIgG1wtLambda | LCDR3 | PRT | SEQ ID NO:913 |

-continued

| TPP ID | Sequence Name | Sequence Region | Type | SEQ ID |
|---|---|---|---|---|
| TPP-29367 | 18206-hIgG1wtLambda | VH | DNA | SEQ ID NO:914 |
| TPP-29367 | 18206-hIgG1wtLambda | HCDR1 | DNA | SEQ ID NO:915 |
| TPP-29367 | 18206-hIgG1wtLambda | HCDR2 | DNA | SEQ ID NO:916 |
| TPP-29367 | 18206-hIgG1wtLambda | HCDR3 | DNA | SEQ ID NO:917 |
| TPP-29367 | 18206-hIgG1wtLambda | VL | DNA | SEQ ID NO:918 |
| TPP-29367 | 18206-hIgG1wtLambda | LCDR1 | DNA | SEQ ID NO:919 |
| TPP-29367 | 18206-hIgG1wtLambda | LCDR2 | DNA | SEQ ID NO:920 |
| TPP-29367 | 18206-hIgG1wtLambda | LCDR3 | DNA | SEQ ID NO:921 |
| TPP-29367 | 18206-hIgG1wtLambda | HC | PRT | SEQ ID NO:922 |
| TPP-29367 | 18206-hIgG1wtLambda | LC | PRT | SEQ ID NO:923 |
| TPP-29367 | 18206-hIgG1wtLambda | HC | DNA | SEQ ID NO:924 |
| TPP-29367 | 18206-hIgG1wtLambda | LC | DNA | SEQ ID NO:925 |
| TPP-29368 | 18432-hIgG1wtLambda | VH | PRT | SEQ ID NO:926 |
| TPP-29368 | 18432-hIgG1wtLambda | HCDR1 | PRT | SEQ ID NO:927 |
| TPP-29368 | 18432-hIgG1wtLambda | HCDR2 | PRT | SEQ ID NO:928 |
| TPP-29368 | 18432-hIgG1wtLambda | HCDR3 | PRT | SEQ ID NO:929 |
| TPP-29368 | 18432-hIgG1wtLambda | VL | PRT | SEQ ID NO:930 |
| TPP-29368 | 18432-hIgG1wtLambda | LCDR1 | PRT | SEQ ID NO:931 |
| TPP-29368 | 18432-hIgG1wtLambda | LCDR2 | PRT | SEQ ID NO:932 |
| TPP-29368 | 18432-hIgG1wtLambda | LCDR3 | PRT | SEQ ID NO:933 |
| TPP-29368 | 18432-hIgG1wtLambda | VH | DNA | SEQ ID NO:934 |
| TPP-29368 | 18432-hIgG1wtLambda | HCDR1 | DNA | SEQ ID NO:935 |
| TPP-29368 | 18432-hIgG1wtLambda | HCDR2 | DNA | SEQ ID NO:936 |
| TPP-29368 | 18432-hIgG1wtLambda | HCDR3 | DNA | SEQ ID NO:937 |
| TPP-29368 | 18432-hIgG1wtLambda | VL | DNA | SEQ ID NO:938 |
| TPP-29368 | 18432-hIgG1wtLambda | LCDR1 | DNA | SEQ ID NO:939 |
| TPP-29368 | 18432-hIgG1wtLambda | LCDR2 | DNA | SEQ ID NO:940 |
| TPP-29368 | 18432-hIgG1wtLambda | LCDR3 | DNA | SEQ ID NO:941 |
| TPP-29368 | 18432-hIgG1wtLambda | HC | PRT | SEQ ID NO:942 |
| TPP-29368 | 18432-hIgG1wtLambda | LC | PRT | SEQ ID NO:943 |
| TPP-29368 | 18432-hIgG1wtLambda | HC | DNA | SEQ ID NO:944 |
| TPP-29368 | 18432-hIgG1wtLambda | LC | DNA | SEQ ID NO:945 |
| TPP-29369 | 19571-hIgG1wtlambda | VH | PRT | SEQ ID NO:946 |
| TPP-29369 | 19571-hIgG1wtlambda | HCDR1 | PRT | SEQ ID NO:947 |
| TPP-29369 | 19571-hIgG1wtlambda | HCDR2 | PRT | SEQ ID NO:948 |
| TPP-29369 | 19571-hIgG1wtlambda | HCDR3 | PRT | SEQ ID NO:949 |
| TPP-29369 | 19571-hIgG1wtlambda | VL | PRT | SEQ ID NO:950 |
| TPP-29369 | 19571-hIgG1wtlambda | LCDR1 | PRT | SEQ ID NO:951 |
| TPP-29369 | 19571-hIgG1wtlambda | LCDR2 | PRT | SEQ ID NO:952 |
| TPP-29369 | 19571-hIgG1wtlambda | LCDR3 | PRT | SEQ ID NO:953 |
| TPP-29369 | 19571-hIgG1wtlambda | VH | DNA | SEQ ID NO:954 |
| TPP-29369 | 19571-hIgG1wtlambda | HCDR1 | DNA | SEQ ID NO:955 |
| TPP-29369 | 19571-hIgG1wtlambda | HCDR2 | DNA | SEQ ID NO:956 |
| TPP-29369 | 19571-hIgG1wtlambda | HCDR3 | DNA | SEQ ID NO:957 |
| TPP-29369 | 19571-hIgG1wtlambda | VL | DNA | SEQ ID NO:958 |
| TPP-29369 | 19571-hIgG1wtlambda | LCDR1 | DNA | SEQ ID NO:959 |
| TPP-29369 | 19571-hIgG1wtlambda | LCDR2 | DNA | SEQ ID NO:960 |
| TPP-29369 | 19571-hIgG1wtlambda | LCDR3 | DNA | SEQ ID NO:961 |
| TPP-29369 | 19571-hIgG1wtlambda | HC | PRT | SEQ ID NO:962 |
| TPP-29369 | 19571-hIgG1wtlambda | LC | PRT | SEQ ID NO:963 |
| TPP-29369 | 19571-hIgG1wtlambda | HC | DNA | SEQ ID NO:964 |
| TPP-29369 | 19571-hIgG1wtlambda | LC | DNA | SEQ ID NO:965 |

Definitions

Unless otherwise defined, all scientific and technical terms used in the description, figures and claims have their ordinary meaning as commonly understood by one of ordinary skill in the art. All publications, patent applications, patents, and other references mentioned herein are incorporated by reference in their entirety. In case of conflict, the present specification, including definitions, will prevail. If two or more documents incorporated by reference include conflicting and/or inconsistent disclosure with respect to each other, then the document having the later effective date shall control. Where reference to a database is made, the effective data shall be the version number applicable 26 May 2021, if not indicated otherwise. The materials, methods, and examples are illustrative only and are not intended to be limiting. Unless stated otherwise, the following terms used in this document, including the description and claims, have the definitions given below.

The expression "about" or "~" as used herein refers to a value being within an acceptable error range for the particular value as determined by one of ordinary skill in the art, which will depend in part on how the value is measured or determined, i.e., on the limitations of the measurement system. For example, "about" can mean within 1 or more than 1 standard deviation, per the practice in the art. The term "about" is also used to indicate that the amount or value in question may be the value designated or some other value that is approximately the same. The phrase is intended to convey that similar values promote equivalent results or effects as described herein. In this context "about" may refer to a range above and/or below of up to 10%. Wherever the term "about" is specified for a certain assay or embodiment, that definition prevails for the particular context.

The terms "comprising", "including", "containing", "having" etc. shall be read expansively or open-ended and without limitation. The term comprising when used in the specification includes "consisting of".

Singular forms such as "a", "an" or "the" include plural references unless the context clearly indicates otherwise. Thus, for example, reference to "a monoclonal antibody" includes a single monoclonal antibody as well as a plurality of monoclonal antibodies, either the same or different. Likewise reference to "cell" includes a single cell as well as a plurality of cells.

Unless otherwise indicated, the term "at least" preceding a series of elements is to be understood to refer to every element in the series. The terms "at least one" and "at least one of" include for example, one, two, three, four, five or more elements.

It is furthermore understood that slight variations above and below a stated range can be used to achieve substantially the same results as a value within the range. Also, unless indicated otherwise, the disclosure of ranges is intended as a continuous range including every value between the minimum and maximum values.

The term "amino acid" or "amino acid residue" as used herein typically refers to a naturally-occurring amino acid. The one letter code is used herein to refer to the respective amino acid. As used herein, a "charged amino acid" is an amino acid which is negatively charged or positively charged. "Negatively charged amino acids" are aspartic acid (D) and glutamic acid (E). "Positively charged amino acids" are arginine (R) lysine (K) and histidine (H). "Polar amino acids" are all amino acids that form hydrogen bonds as donors or acceptors. These are all charged amino acids and asparagine (N), glutamine (Q), serine (S), threonine (T), tyrosine (Y) and cysteine (C). "Polar uncharged amino acids" are asparagine (N), glutamine (Q), serine (S), threonine (T), tyrosine (Y) and cysteine (C). "Amphiphatic amino acids" are tryptophan (W), tyrosine (Y) and methionine (M). "Aromatic amino acids" are phenylalanine (F), tyrosine (Y), and tryptophan (W). "Hydrophobic amino acids" are glycine (G), alanine (A), valine (V), leucine (L), isoleucine (I), proline (P), phenylalanine (F), methionine (M) and cysteine. "Small amino acids" are glycine (G), alanine (A), serine (S), proline (P), threonine (T), aspartic acid (D) and asparagine (N).

As used herein, the terms "peptide", "polypeptide", and "protein" are used interchangeably, and refer to a compound comprised of amino acid residues covalently linked by peptide bonds. A protein or peptide must contain at least two amino acids, and no limitation is placed on the maximum number of amino acids. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

Where generic reference is made to a gene or protein from a certain species such as mouse, the analogue from human shall likewise be meant, if not stated otherwise or obviously incompatible. This holds in particular in the context of biomarkers.

The term "isolated" when applied to a nucleic acid, polypeptide, protein or antibody, denotes that the nucleic acid, polypeptide, protein or antibody is essentially free of other cellular components with which it is associated in the natural state. It is preferably in a homogeneous state. It can be in either a dry or aqueous solution. Purity and homogeneity are typically determined using analytical chemistry techniques such as polyacrylamide gel electrophoresis or high-performance liquid chromatography. A protein, polypeptide or antibody that is the predominant species present in a preparation is substantially purified. In particular, an isolated gene is separated from open reading frames that flank the gene and encode a protein other than the gene of interest. An isolated polypeptide may however be immobilized, e.g. on beads or particles, e.g. via a suitable linker.

The term "purified" denotes that a nucleic acid or protein gives rise to essentially one band in an electrophoretic gel. Particularly, it means that the nucleic acid or protein is at least 85% pure, more preferably at least 95% pure, and most preferably at least 99% pure.

As used herein, the term "synthetic", with reference to, for example, a synthetic nucleic acid molecule or a synthetic gene or a synthetic peptide refers to a nucleic acid molecule or polypeptide molecule that is produced by recombinant methods and/or by chemical synthesis methods. As used herein, production by recombinant means by using recombinant DNA methods means the use of the well-known methods of molecular biology for expressing proteins encoded by cloned DNA.

"Post-translational modification(s)" (PTM) refer to the covalent modification(s) of peptides or proteins, which are introduced following protein biosynthesis under natural conditions. The term includes without limitation glycosylation, phosphorylation, acylation, adenylation, farnesylation, ubiquitination, and sulfation. Post-translational modifications may influence the activity of peptides or proteins. In 2004, Gutierrez et al. have described the sulfation and glycosylation state of the murine CCR8 chemokine receptor, and the way in which these post-translational modifications affect CCR8 activity. They suggest that tyrosines at positions 14 and 15 in mouse CCR8 are sulfated amino acid residues, whereas asparagine 8 and threonines 10 and 12 are glycosylated. Furthermore, they show that the sulfations are important for the activity of CCR8 (Gutierrez, Julio, et al. "Analysis of post-translational CCR8 modifications and their influence on receptor activity." Journal of Biological Chemistry 279.15 (2004): 14726-14733.).

A "sulfation" is a posttranslational modification where a sulfate group is added to an amino acid such as a tyrosine residue of a polypeptide or protein. Tyrosine sulfation occurs in all multicellular organisms. Under physiological conditions it is catalyzed by tyrosylprotein sulfotransferases (TPSTs) 1 and 2, Golgi-resident enzymes which transfer sulfate from the cofactor PAPS (3'-phosphoadenosine 5'-phosphosulfate) to a context-dependent tyrosine in a protein substrate. Synthetic sulfation of tyrosine may be performed with a technique known in the art, e.g. as described in Bunschoten, Anton, et al. "A general sequence independent solid phase method for the site specific synthesis of multiple sulfated-tyrosine containing peptides." Chemical Communications 21 (2009): 2999-3001. A sulfated polypeptide is a polypeptide comprising at least one sulfation. A non-sulfated polypeptide is a polypeptide comprising no sulfation.

A "tyrosine rich domain" (TRD) is a conserved domain which characterizes seven transmembrane proteins such as CXC and CC chemokine receptors. The TRD is typically located at the N terminus of the chemokine receptor and is typically linked to a LID domain via a cysteine, cf. FIG. 2B. Thus, as used herein, the term TRD refers to the amino acid or protein sequence of a CXC or CC chemokine receptor which is located N terminal of the first cysteine counted from the N terminus. The TRD may or may not comprise a signal peptide. The TRD may or may not be modified. Besides tyrosine, a TRD often comprises negatively charged amino acid residues such as aspartic acid. TRDs have been proposed to be important structures for the interaction of chemokine receptors with their endogenous ligands. Under physiological conditions, the tyrosine residues in a TRD can be sulfated, non-sulfated or partially sulfated. The specific sequences for the TRDs of the respective chemokine receptors are provided in Table 4.1. However, it is obvious that mutations may be introduced in the TRD sequence without changing the overall charge and interaction pattern. Preferably, a TRD has at least a 90%, 95% or 99% sequence identity or sequence similarity with at least one TRD sequence according to Table 4.1.

The term "N terminus" or "N term" of a chemokine receptor as used herein refers to the N terminal amino acids of the chemokine receptor comprising at least the TRD. Where a polypeptide or protein comprises a signal peptide, the N terminus may also refer to the N terminal sequence behind the natural cleavage site of the polypeptide or protein. According to some preferred embodiments, the N terminus comprises the LID domain and the TRD domain of a chemokine receptor but does not comprise the natural cysteine between these two domains. Instead, the cysteine can be removed or can be replaced by a different amino acid.

The "LID" domain of a chemokine receptor as used herein refers to an amino acid sequence located C terminal of the TRD of the chemokine receptor. TRD and LID domain are typically separated by a single cysteine.

"Sequence identity" or "percent identity" is a number that describes how similar a query sequence is to a target sequence, more precisely how many characters in each sequence are identical after alignment. The most popular tool to calculate sequence identity is BLAST (basic local alignment search tool, blast.ncbi.nlm.nih.gov), which performs comparisons between pairs of sequences, searching for regions of local similarity. Suitable alignment methods are known in the art, e.g. Needleman-Wunsch algorithm for global-global alignment, using BLOSUM62 matrix, with gap opening penalty of 11 and a gap extension penalty of 1. Afterwards, the pairs of aligned identical residues can be counted and then divided by the total length of the alignment (including gaps, internal as well as external) to arrive at the percent identity value.

For "percent similarity" or "sequence similarity" values, the same approach as for percent identity values can be used, except that what is counted, instead of pairs of identical residues, is the aligned residue pairs with BLOSUM62 values that are not negative (i.e., ≥0).

"Seven transmembrane receptors" (7-TM receptors) are integral membrane proteins that contain seven membrane-spanning helices. As used herein, 7-TM receptors are G protein-coupled receptors.

"Chemokine receptors" are seven transmembrane receptors. The chemokine receptor family contains 24 members in humans and can be subdivided, based on the class of chemokines they bind, into four subfamilies: CX3CR, CXCR, CCR, and XCR, all of them activating G proteins, and ACKR, containing 6 atypical receptors, unable to activate G proteins upon ligand binding "CXC chemokine receptors" (CXCR) are integral membrane proteins that specifically bind and respond to cytokines of the CXC chemokine family. They represent one subfamily of chemokine receptors, a large family of G protein-linked receptors that are known as seven transmembrane (7-TM) proteins, since they span the cell membrane seven times. There are currently seven known CXC chemokine receptors in mammals, named CXCR1, CXCR2, CXCR3, CXCR4, CXCR5, and CXCR6. CXCR6 is more closely related in structure to CC chemokine receptors than to other CXC chemokine receptors.

"CC chemokine receptors" (CCR, also beta chemokine receptors) are integral membrane proteins that specifically bind and respond to cytokines of the CC chemokine family. They represent one subfamily of chemokine receptors, a large family of G protein-linked receptors that are known as seven transmembrane (7-TM) proteins since they span the cell membrane seven times. The subfamily of the CC chemokine receptors comprises CCR1, CCR2, CCR3, CCR4, CCR5, CCR6, CCR7, CCR8, CCR9 and CCR10.

The term "CCR8" refers to the C-C chemokine receptor type 8. The CCR8 protein is encoded by the gene CCR8 (NCBI gene ID 1237). Synonyms for CCR8 are inter alia CC-CKR-8, CCR-8, CDw198, CKRL1, CMKBR8, CMKBRL2, GPRCY6, CY6, TER1. The CCR8 protein comprises human, murine, rat, *Rhesus macaque* and further mammalian and non-mammalian homologues. Sequence(s) for human CCR8 are accessible via UniProt Identifier P51685 (CCR8_HUMAN), for instance human isoform P51685-1 or P51685-2 (UniProt, Nov. 29, 2019). Sequence(s) for murine CCR8 are accessible via UniProt Identifier P56484 (CCR8_MOUSE). Sequence(s) for *Rhesus macaque* CCR8 are accessible via UniProt Identifier O97665 (CCR8_MACMU). Different isoforms and variants may exist for the different species and are all comprised by the term CCR8. Also comprised are CCR8 molecules before and after maturation, i.e., independent of cleavage of one or more pro-domains. In addition, synthetic variants of the CCR8 protein may be generated and are comprised by the term CCR8. The protein CCR8 may furthermore be subject to various modifications, e.g., synthetic or naturally occurring modifications, such as post translational modifications. Recombinant human CCR8 is commercially available or can be manufactured as known in the art. CCR8 is a receptor for the chemokine CCL1/SCYA1/I-309. Barington et al. have reported the importance of conserved extracellular disulfide bridges and aromatic residues in extracellular loop 2 (ECL-2) for ligand binding and activation in the chemokine receptor CCR8 (Barington, Line, et al. "Role of conserved disulfide bridges and aromatic residues in extracellular loop 2 of chemokine receptor CCR8 for chemokine and small molecule binding." Journal of Biological Chemistry 291.31 (2016): 16208-16220.). Furthermore, they found that two distinct aromatic residues in ECL-2, Tyr184 (Cys+1) and Tyr187 (Cys+4), were crucial for binding of the CC chemokines CCL1 (agonist) and MC148 (antagonist), respectively, but not for small molecule binding.

"Programmed Death-1 (PD-1)" refers to an immunoinhibitory receptor belonging to the CD28 family. PD-1 is expressed predominantly on previously activated T cells in vivo and binds to two ligands, PD-L1 and PD-L2. The term "PD-1" as used herein includes without limitation human PD-1 (hPD-1), variants, isoforms, and species homologs of hPD-1, and analogs having at least one common epitope with hPD-1. The complete hPD-1 sequence can be found under GenBank Accession No. U64863 (Nov. 29, 2019).

"Programmed Death Ligand-1 (PD-L1)" is one of two cell surface glycoprotein ligands for PD-1 (the other being PD-L2) that down regulate T cell activation and cytokine secretion upon binding to PD-1. The term "PD-L1" as used herein includes without limitation human PD-L1 (hPDL1), variants, isoforms, and species homologs of hPD-L1, and analogs having at least one common epitope with hPD-L1. The complete hPD-L1 sequence can be found under GenBank Accession No. Q9NZQ7 (Nov. 29, 2019).

"Tumor Proportion Score" (TPS) is the percentage of viable tumor cells showing partial or complete membrane staining at any intensity. For example, a specimen should be considered to have PD-L1 expression if TPS≥1% and high PDL1 expression if TPS≥50%. For example, PD-L1 protein expression in NSCLC is usually determined by using Tumor Proportion Score (TPS).

"Combined Positive Score" (CPS) is the number of staining cells (tumor cells, lymphocytes, macrophages) divided by the total number of viable tumor cells, multiplied by 100. For example, a specimen should be considered to have PD-L1 expression if CPS≥1 and to have high PD-L1 expression if CPS≥10. The FDA has approved the use of the PD-L1 IHC 22C3 pharmDx assay to determine a patient's eligibility for therapeutic antibody pembrolizumab.

"FOXP3" is a 50-55 kD transcription factor, also known as Forkhead box protein P3, Scurfin, JM2, or IPEX. It is proposed to be a master regulatory gene and more specific marker of T regulatory cells than most cell surface markers. Transduced expression of FOXP3 in CD4+/CD25- cells has been shown to induce GITR, CD103, and CTLA4 and impart a T regulatory cell phenotype. Biolegend antibody clones 206D and 259D recognize a human FOXP3 epitope in the region of amino acids 105-235. Poly6238 recognizes both human and mouse FOXP3 and was raised against the N-terminal portion of FOXP3.

The term "modulation" refers to any alteration of an existing process or behavior, such as blocking (antagonism) and induction (agonism). For example, modulation of G protein independent signaling refers to any significant alteration of G-protein independent signaling.

The term "internalization" of an antibody, fragment or conjugate refers to the uptake of the antibody, fragment or conjugate into a cell. Preferably, internalization is determined for a cell line with endogenous target expression, e.g. as described elsewhere herein for human or murine CCR8. Preferably, internalization is determined by measuring total internalized fluorescence intensity per cell and is quantified relative to an isotype control, e.g. as described in example 10.5. In brief, the antibody, fragment or conjugate and a matching isotype control are labeled with a dye and internalized fluorescence is determined and quantified for the antibody, fragment or conjugate relative to the isotype control. A "non-internalizing antibody" is defined as an antibody showing substantially the same internalization as a corresponding isotype control. A "low internalizing antibody" is defined as an antibody showing an internalization which is equal to or lower than the 10-fold of the internalization of the isotype control, preferably lower than the 9-, 8-, 7-, 6-, 5-, 4-, 3-, 2-, 1.5-, 1.4-, 1.3-, 1.2-, or 1.1-fold of the internalization of the isotype control. A "medium internalizing antibody" is defined as an antibody showing an internalization which is equal to or lower than the 21-fold of the internalization of the isotype control and higher than the 10-fold of the internalization of the isotype control. A "high internalizing antibody" is defined as an antibody showing an internalization which is higher than the 21-fold of the internalization of the isotype control.

In the alternative, internalization can furthermore be quantified based on t(½), i.e. time until half of the amount of antibody, fragment or conjugate has been internalized. Preferably, antibodies according to the current invention are characterized by a time until half of the amount of antibody, fragment or conjugate has been internalized which is >2 hours, preferably >4, >5, >6, >7, >8, >9, >10, >11, >12, >13, >14, >15, >16, >17, >18, >19, >20, >21, >22, >23, >24, >26, >28, >30, or >48 hours. Most preferably, antibodies according to the current invention are not internalized at all, i.e., no time can be defined until which half of the amount of antibody, fragment or conjugate has been internalized. An "isotype control" is an antibody or fragment that does not bind a target but has the same class and type as the reference antibody or fragment recognizing the target.

An antibody or fragment is termed "cross-reactive" or "cross reactive" if the antibody or fragment binds an antigen from two or more different species, e.g. with a KD value of 10-7 M or less, more preferably of less than 10-8 M, even more preferably in the range from 10-9 M to 10-11 M.

By the term "specifically binds" as used herein with respect to an antibody, is meant an antibody which recognizes a specific antigen, but does not substantially recognize or bind other molecules in a sample: An antibody characterized by substantial unspecific binding would lack therapeutic applicability, such that these embodiments are excluded. However, as known in the art, specific binding of an antibody or binder does not necessarily exclude an antibody or binder binding to further antigens/target molecules. An antibody that specifically binds to an antigen from one species may also bind to that antigen from one or more further species. Such cross-species reactivity does not itself alter the classification of an antibody as specific.

In some instances, the terms "specific binding" or "specifically binding" can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A", the presence of a molecule containing epitope A (or free, unlabeled A), in a reaction containing labeled "A" and the antibody, will reduce the amount of labeled A bound to the antibody.

In case of doubt, specific binding of an antibody or binder preferably describes binding of an antibody, antibody fragment or binder to its antigen/target with an affinity of at least 10-7 M (as KD value; i.e. preferably those with KD values smaller than 10-7 M), with the antibody or binder having an at least two times lower affinity for a non-specific antigen which is not the predetermined antigen/target molecule or a closely related antigen/target molecule.

"Polyspecificity", also "polyreactivity" or "unspecific binding" refers to the binders' or antibodies' ability to bind a defined set of unrelated antigens. Unspecific binding is substantial, if the (therapeutic) applicability of the antibody is compromised. Polyspecificity for non-protein structures including without limitation target negative cell lines or tissues, baculo virus particle (BVP), insulin or DNA, may be evaluated as known in the art and as described herein. For example, unspecific binding to target negative human cell lines can be determined e.g. by FACS analysis using mock transfected CHO or HEK cells. In a second example, unspecific binding to different tissues can be analyzed by FACS analysis of a cell line or panel of cell lines derived from the respective tissue. In a third example, unspecific binding to immune cell populations can be analyzed by FACS after sorting the immune cell populations as known in the art. In a fourth example, unspecific binding to BVP, insulin or DNA can be analyzed using ELISA, e.g. as described in Hotzel, Isidro, et al. "A strategy for risk mitigation of antibodies with fast clearance." MAbs. Vol. 4. No. 6. Taylor & Francis, 2012.; Avery, Lindsay B., et al. "Establishing in vitro in vivo correlations to screen monoclonal antibodies for physicochemical properties related to favorable human pharmacokinetics." MAbs. Vol. 10. No. 2. Taylor & Francis, 2018, and Jain, Tushar, et al. "Biophysical properties of the clinical-stage antibody landscape." Proceedings of the National Academy of Sciences 114.5 (2017): 944-949, incorporated herein in their entirety and in particular with regards to the technical details necessary to analyze and quantify unspecific binding. An antibody without substantial unspecific binding is preferably characterized by an unspecific binding that is lower than unspecific binding of reference antibody Gantenerumab (Roche) and most preferably lower than unspecific binding of reference antibody Remicade (Janssen Biotech).

The term "off target binding" refers to the ability of an antibody to bind individual proteins different from the intended target, for example proteins of the targets' protein family. Off target binding may be evaluated using commercial assays known in the art such as the Retrogenix off target profiling assay. In brief, antibodies are tested on microarrays containing HEK293 cells individually expressing several thousand human membrane proteins and secreted proteins. Binding of the antibody to a potential off target has to be confirmed by FACS using cells overexpressing the potential off target.

The term "affinity" is a term of the art and describes the strength of binding between a binder, antibody or antibody fragment and a target. The "affinity" of antibodies and fragments thereof for a target can be determined using techniques well known in the art or described herein, for example by ELISA, isothermal titration calorimetry (ITC), surface plasmon resonance (SPR), flow cytometry or fluorescent polarization assays. Preferably the affinity is provided as dissociation constant KD.

The "dissociation constant" (KD) has molar units (M) and corresponds to the concentration of the binder/antibody at which half of the target proteins are occupied at equilibrium. The smaller the dissociation constant is, the higher is the affinity between the binder or antibody and its target. According to the current invention, the antibodies preferably have a target affinity of at least 10-7 M (as KD value), more preferably of at least 10-8 M, even more preferably in the range from 10-9 M to 10-11 M. The KD values can be preferably determined by means of surface plasmon resonance spectroscopy, e.g. as described elsewhere herein. Where assay conditions were found to influence the determined KD, the assay setup with the least standard deviation shall be used.

"Half maximal effective concentration" (EC50) refers to the concentration of a drug, antibody, fragment, conjugate or molecule which induces a response halfway between the baseline and maximum after a specified incubation time. In the context of antibody binding, the EC50 thus reflects the antibody concentration needed for half-maximal binding. An EC50 can be determined if an inflection point can be determined by mathematical modeling (e.g., non-linear regression) of the dose-response curve describing the relationship between applied drug, antibody, fragment, conjugate or molecule concentration and signal. For example, if the dose-response curve follows a sigmoidal curve, an EC50 can be determined. Where the response is an inhibition, the EC50 is termed half maximal inhibitory concentration (IC50). EC80 can be determined mutatis mutandis.

The term "antibody" (Ab) refers to an immunoglobulin molecule (e.g. without limitation human IgG1, IgG2, IgG3, IgG4, IgM, IgD, IgE, IgA1, IgA2, mouse IgG1, IgG2a, IgG2b, IgG2c, IgG3, IgA, IgD, IgE or IgM, rat IgG1, IgG2a, IgG2b, IgG2c, IgA, IgD, IgE or IgM, rabbit IgA1, IgA2, IgA3, IgE, IgG, IgM, goat IgA, IgE, IgG1, IgG2, IgE, IgM or chicken IgY) that specifically binds to, or is immunologically reactive with, a particular antigen. Antibodies or antibody fragments comprise complementarity determining regions (CDRs), also known as hypervariable regions, in both the light chain and heavy chain variable domains. The more highly conserved portions of the variable domains are called the framework (FR). As is known in the art, the amino acid position/boundary delineating a hypervariable region of an antibody can vary, depending on the context and the various definitions known in the art. As used herein, numbering of immunoglobulin amino acid residues is done according to the immunoglobulin amino acid residue numbering system of Kabat et al. The variable domains of native heavy and light chains each comprise four FR regions. The three CDRs in each chain are held together in close proximity by the FR regions and, with the CDRs from the other chain, contribute to the formation of the antigen binding site of antibodies, see Kabat, E. A., et al. "Sequences of Proteins of Immunological Interest (Natl. Inst. Health, Bethesda, Md.), GPO Publ." No 165-462 (1987). The term antibody as used herein also refers to antibody fragments, except where explicitly stated otherwise. Depending on the respective context, the term antibody may also refer to any proteinaceous binding molecule with immunoglobulin-like function.

The term "CDR" refers to the complementary determining region of the antibody. As known in the art complementarity-determining regions (CDRs) are part of the variable chains in antibodies and T cell receptors. A set of CDRs constitutes a paratope. CDRs are crucial to the diversity of antigen specificities. There are three CDRs (CDR1, CDR2 and CDR3), arranged non-consecutively on the amino acid sequence of a variable domain of an antigen receptor. Since the antigen receptors are typically composed of two variable domains (on two different polypeptide chains, heavy and light chain), there are usually six CDRs for each antigen receptor that can collectively come into contact with the antigen. The CDRs of the light chain are LCDR1, LCDR2 and LCDR3. The CDRs of the heavy chain are termed HCDR1, HCDR2 and HCDR3. HCDR3 is the most variable complementary determining region (see, e.g., Chothia, Cyrus, and Arthur M. Lesk. "Canonical structures for the hypervariable regions of immunoglobulins." Journal of molecular biology 196.4 (1987): 901-917.; Kabat, E. A., et al. "Sequences of proteins of immunological interest. Bethesda, Md.: US Department of Health and Human Services." Public Health Service, National Institutes of Health (1991): 103-511.).

The "constant region" refers to the portion of the antibody molecule that confers effector functions. The heavy chain constant region can be selected from any of the five isotypes: alpha (a), delta (6), epsilon (c), gamma (g), or mu (O).

The term "Fc domain", "Fc region" or "Fc part" as used herein refers to a C-terminal region of an antibody heavy chain that contains at least a portion of the constant region. The term includes native sequence Fc regions and variant Fc regions. For example, a human IgG heavy chain Fc region may extend from Cys226, or from Pro230, to the carboxyl-terminus of the heavy chain.

Antibodies or binding fragments according to the current invention may have been modified to alter at least one constant region-mediated biological effector function. For example, in some embodiments, an antibody may be modified to reduce or enhance at least one constant region-mediated biological effector function relative to the unmodified antibody, e.g., reduced or improved binding to the Fc receptor (FcγR). FcγR binding may be reduced, e.g. by mutating the immunoglobulin constant region segment of the antibody at particular regions necessary for FcγR interactions (see, e.g., Canfield, Stephen M., and Sherie L. Morrison. "The binding affinity of human IgG for its high affinity Fc receptor is determined by multiple amino acids in the CH2 domain and is modulated by the hinge region." The Journal of experimental medicine 173.6 (1991): 1483-1491; and Lund, John, et al. "Human Fc gamma RI and Fc gamma RII interact with distinct but overlapping sites on human IgG." The Journal of Immunology 147.8 (1991): 2657-2662.). FcγR binding may be enhanced, e.g. by afucosylation. Reducing FcγR binding may also reduce other effector functions which rely on FcγR interactions, such as opsonization, phagocytosis and antigen-dependent cellular cytotoxicity ("ADCC").

Furthermore, addressing the interaction of Fc with FcRn allows to modulate the half-life of antibodies in vivo. Abrogating the interaction by e.g. introduction of mutation H435A leads to an extremely short half-life, since the antibody is no longer protected from lysosomal degradation by FcRn recycling. In some preferred embodiments according to all aspects, the antibody according to the current invention comprises mutation H435A or has otherwise been engineered for a reduced half-life.

In contrast, antibodies comprising "YTE" mutations (M252Y/S254T/T256E) and/or equivalent mutations such as "LS" mutations (M428L/N434S) have been shown to significantly extend the half-life by more efficient recycling from endosomes in both pre-clincal species as well as humans (Dall'Acqua, William F., et al. "Increasing the affinity of a human IgG1 for the neonatal Fc receptor: biological consequences." The Journal of Immunology 169.9 (2002): 5171-5180.; Zalevsky, Jonathan, et al "Enhanced antibody half-life improves in vivo activity." Nature biotechnology 28.2 (2010): 157-159.). In some preferred embodiments according to all aspects, the antibody according to the current invention comprises YTE mutations (M252Y/S254T/T256E) and/or equivalent mutations such as LS (M428L/N434S) or has otherwise been engineered for an improved half-life. Suitable Fc engineering approaches for extension of half-life can be found in Haraya, Kenta, Tatsuhiko Tachibana, and Tomoyuki Igawa. "Improvement of pharmacokinetic properties of therapeutic antibodies by antibody engineering." Drug metabolism and pharmacokinetics 34.1 (2019): 25-41., and/or Lee, Chang-Han, et al. "An engineered human Fc domain that behaves like a pH-toggle switch for ultra-long circulation persistence." Nature communications 10.1 (2019): 1-11., both incorporated herein by reference.

"Afucosylated" antibodies are antibodies engineered such that the oligosaccharides in the Fc region of the antibody do not have any fucose sugar units. Glycosylation of an antibody can alter its function. For example, if glycosylation at N297 in the CH2 domain of an IgG is completely eliminated, binding to FcγRs is lost. However, modulation of the specific carbohydrate composition at N297 can have the opposite effect and enhance the ADCC activity of the antibody. In brief, the affinity of an antibody for the activating FcγRs depends on the composition of the N297 N-linked oligosaccharide. There are 32 different possible combinations of oligosaccharides that can occur at this site. Naturally occurring human IgG and those produced by hybridomas or other common expression systems are usually composed of N-acetylglucosamine (GlcNAc) and three mannose residues that form a core carbohydrate. This core is attached to two additional GlcNAc groups to form biantennary branches. The addition of galactose at each branch can occur as well as the terminal addition of sialic acid to these galactose molecules. Fucose is often part of the core GlcNAc. This fucose, through steric hindrance, obstructs the interaction of the antibody with the FcγRIIIA. Thus, elimination of this fucose molecule while maintaining other forms of glycosylation at this site increases the binding of the antibody to the activating FcγRs, enhancing its ability to elicit ADCC and/or ADCP (Almagro, Juan C., et al. "Progress and challenges in the design and clinical development of antibodies for cancer therapy." Frontiers in immunology 8 (2018): 1751.). Methods of preparing fucose-less antibodies include growth in rat myeloma YB2/0 cells (ATCC CRL 1662). YB2/0 cells express low levels of FUT8 mRNA, which encodes α-1,6-fucosyltransferase, an enzyme necessary for fucosylation of polypeptides. Afucosylated antibodies are preferred for the current invention.

"Antibody-dependent cellular cytotoxicity" ("ADCC"), also referred to as "antibody-dependent cell-mediated cytotoxicity", is a mechanism of cell-mediated immune defense whereby an immune cell actively lyses a target cell, whose membrane-surface antigens have been bound by specific antibodies. ADCC is mediated via interaction of the antibody or fragment with FcγRIIIa. In humans, FcγRIII exists in two different forms: FcγRIIIa (CD16a) and FcγRIIIb (CD16b). While FcγRIIIa is expressed on monocytes, neutrophils, mast cells, macrophages, and natural killer cells as a transmembrane receptor, FcγRIIIb is only expressed on neutrophils. These receptors bind to the Fc portion of IgG antibodies, which then activates antibody-dependent cell-mediated cytotoxicity (ADCC) mediated by the human effector cells.

Different assay systems to determine ADCC induction in human subjects have been described in the literature and are suitable for characterization of the subject matter disclosed herein. For example, Yao-Te Hsieh et al. have studied different ADCC assay systems, namely assays based on (i) natural killer cells from human donors (FcγRIIIA+primary NK), (ii) FcγRIIIA engineered NK-92 cells and (iii) FcγRIIIA/NFAT-RE/luc2 engineered Jurkat T cells (Hsieh, Yao-Te, et al. "Characterization of FcγRIIIA effector cells used in in vitro ADCC bioassay: comparison of primary NK cells with engineered NK-92 and Jurkat T cells." Journal of Immunological Methods 441 (2017): 56-66, incorporated herein in entirety; in particular, reference is made to the method description for these assays). In brief, all three effector cell systems differentially express FcγRIIIA and provide dose-dependent ADCC pathway activity, yet only primary NK and engineered NK-92 cells are capable of inducing ADCC-mediated cell lysis. For functional assessment of ADCC activity, primary NK or NK-92 (V-158) cells thus better reflect the physiologically relevant ADCC mechanism of action. As an engineered cell line, NK-92 cells may behave more reproducibly than primary NK and is therefore the preferred assay system to determine ADCC response in human subjects, e.g. in case of doubt.

An antibody or antigen-binding fragment inducing ADCC is an antibody which may elicit a substantial amount of lysis of target cells in the presence of NK effector cells. Preferably, the ADCC induction results in the lysis of at least 2%, 5%, 10%, 15%, 20%, 25%, 30%, 35%, 40%, 45%, 50%, 55%, 60%, 65%, 70%, 75%, 80%, 85%, 90%, 95% or 99% of the target cells.

"Antibody-dependent cellular phagocytosis" ("ADCP") is the mechanism by which antibody-opsonized target cells activate the FcγRs on the surface of macrophages to induce phagocytosis, resulting in internalization and degradation of the target cell. For ADCP, binding to macrophages as effector cells typically occurs via the interaction of the antibodies FC part with FcγRIIa (CD32a) expressed by macrophages.

An antibody or antigen-binding fragment inducing ADCP is an antibody which may elicit a substantial amount of phagocytosis of target cells in the presence of macrophages. Preferably, the ADCP induction results in the phagocytosis of at least 2%, 5%, 10%, 15%, 20%, 25%, 30%, 35%, 40%, 45%, 50%, 55%, 60%, 65%, 70%, 75%, 80%, 85%, 90%, 95% or 99% of the target cells. "Complement-dependent cytotoxicity" ("CDC") is an effector function of IgG and IgM antibodies.

When they are bound to a surface antigen on a target cell (e.g. bacterial or viral infected cell), the classical complement pathway is triggered by bonding protein C1q to these antibodies, resulting in formation of a membrane attack complex (MAC) and target cell lysis. Complement system is efficiently activated by human IgG1, IgG3 and IgM antibodies, weakly by IgG2 antibodies and is not activated by IgG4 antibodies. It is one mechanism of action by which therapeutic antibodies—also specific embodiments of the antibodies according to the current invention—can achieve an antitumor effect. Several laboratory methods exist for determining the efficacy of CDC and are known in the art.

An antibody or antigen-binding fragment inducing CDC is an antibody which may elicit a substantial amount of formation of a membrane attack complex and lysis of target cells. Preferably, the CDC induction results in the lysis of at least 2%, 5%, 10%, 15%, 20%, 25%, 30%, 35%, 40%, 45%, 50%, 55%, 60%, 65%, 70%, 75%, 80%, 85%, 90%, 95% or 99% of the target cells.

Antibodies comprising an Fc region may or may not comprise a modification promoting the association of the first and the second subunit of the Fc domain.

A "modification promoting the association of the first and the second subunit of the Fc domain" is a manipulation of the peptide backbone or the post-translational modifications of an Fc domain subunit that reduces or prevents the association of a polypeptide comprising the Fc domain subunit with an identical polypeptide to form a homodimer. Antibodies comprising an Fc region may or may not comprise a modification promoting the association of the first and the second subunit of the Fc domain. A modification promoting association as used herein particularly includes separate modifications made to each of the two Fc domain subunits desired to associate (i.e. the first and the second subunit of the Fc domain), wherein the modifications are complementary to each other so as to promote association of the two Fc domain subunits. For example, a modification promoting association may alter the structure or charge of one or both of the Fc domain subunits so as to make their association sterically or electrostatically favorable. Thus, (hetero)dimerization occurs between a polypeptide comprising the first Fc domain subunit and a polypeptide comprising the second Fc domain subunit, which might be non-identical, e.g. in the sense that further components fused to each of the subunits (e.g. antigen binding moieties) are not the same. In some embodiments the modification promoting association comprises an amino acid mutation in the Fc domain, specifically an amino acid substitution. In a particular embodiment, the modification promoting association comprises a separate amino acid mutation, specifically an amino acid substitution, in each of the two subunits of the Fc domain.

A "fragment" of an antibody as used herein is required to substantially retain the desired affinity of the full-length antibody. As such, suitable fragments of an anti-human CCR8 antibody will retain the ability to bind to the target chemokine receptor, e.g. to bind to human CCR8 receptor. Fragments of an antibody comprise a portion of a full-length antibody, generally the antigen binding or variable region thereof. Examples of antibody fragments include, but are not limited to, Fab, Fab', F(ab')2, and Fv fragments, single-chain antibody molecules, diabodies and domain antibodies, see Holt, Lucy J., et al. "Domain antibodies: proteins for therapy." Trends in biotechnology 21.11 (2003): 484-490.

A "Fab fragment" contains the constant domain of the light chain and the first constant domain (CH2) of the heavy chain.

"Fab' fragments" differ from Fab fragments by the addition of a few residues at the carboxyl terminus of the heavy chain CH2 domain including one or more cysteines from the antibody hinge region.

"F(ab) fragments" are produced by cleavage of the disulfide bond at the hinge cysteines of the F(ab')2 pepsin digestion product. Additional chemical couplings of antibody fragments are known to those of ordinary skill in the art. Fab and F(ab')2 fragments lack the Fc fragment of intact antibody, clear more rapidly from the circulation of animals, and may have less non-specific tissue binding than an intact antibody, see, e.g., Wahl, Richard L., Charles W. Parker, and Gordon W. Philpott. "Improved radioimaging and tumor localization with monoclonal F (ab') 2." Journal of nuclear medicine: official publication, Society of Nuclear Medicine 24.4 (1983): 316-325.

An "Fv fragment" is the minimum fragment of an antibody that contains a complete target recognition and binding site. This region consists of a dimer of one heavy and one light chain variable domain in a tight, non-covalent association (VH-VL dimer). It is in this configuration that the three CDRs of each variable domain interact to define an antigen binding site on the surface of the VH-VL dimer. Often, the six CDRs confer antigen binding specificity upon the antibody. However, in some instances even a single variable domain (or half of an Fv comprising only three CDRs specific for a target) may have the ability to recognize and bind the antigen, although at a lower affinity than the entire binding site.

"Single-chain Fv" or "scFv" antibody fragments comprise the VH and VL domains of an antibody in a single polypeptide chain. Generally, the Fv polypeptide further comprises a polypeptide linker between the VH and VL domains which enables the scFv to form the desired structure for antigen binding.

"Single domain antibodies" are composed of single VH or VL domains which exhibit sufficient affinity to the target. In a specific embodiment, the single domain antibody is a camelized antibody, see, e.g., Riechmann, Lutz, and Serge Muyldermans. "Single domain antibodies: comparison of camel VH and camelised human VH domains." Journal of immunological methods 231.1-2 (1999): 25-38.

"Bispecific antibodies" are monoclonal antibodies that have binding specificities for at least two different epitopes on the same or different antigens. In the present disclosure, one of the binding specificities can be directed towards the target chemokine receptor such as CCR8, the other can be for any other antigen, e.g., without limitation for a cell-surface protein, receptor, receptor subunit, tissue-specific antigen, virally derived protein, virally encoded envelope protein, bacterially derived protein, or bacterial surface protein. Bispecific antibody constructs according to the invention also encompass multispecific antibody constructs comprising multiple binding domains/binding sites, such as trispecific antibody constructs, where the construct comprises three binding domains.

"Derivatized antibodies" are typically modified by glycosylation, acetylation, pegylation, phosphorylation, sulfation, amidation, derivatization by known protecting/blocking groups, proteolytic cleavage, linkage to a cellular ligand or other protein. Any of numerous chemical modifications may be carried out by known techniques, including, but not limited to, specific chemical cleavage, acetylation, formylation, metabolic synthesis of tunicamycin, etc. Additionally, the derivative may contain one or more non-natural amino acids, e.g., using ambrx technology, see, e.g., Wolfson, Wendy. "Amber codon flashing ambrx augments proteins with unnatural amino acids." Chemistry & biology 13.10 (2006): 1011-1012.

Antibodies according to the current invention may be derivatized, e.g. glycosylated or sulfated. "Monoclonal antibodies" are substantially homogenous populations of antibodies binding a particular antigen. Monoclonal immunoglobulins may be obtained by methods well known to those skilled in the art (see for example, Kohler, Georges, and Cesar Milstein. "Continuous cultures of fused cells secreting antibody of predefined specificity." nature 256.5517 (1975): 495-497., and U.S. Pat. No. 4,376,110). An immunoglobulin or immunoglobulin fragment with specific binding affinity can be isolated, enriched, or purified from a prokaryotic or eukaryotic organism. Routine methods known to those skilled in the art enable production of both immunoglobulins or immunoglobulin fragments and proteinaceous binding molecules with immunoglobulin-like functions, in both prokaryotic and eukaryotic organisms. The antibodies according to the current invention are preferably monoclonal.

"Humanized antibodies" contain CDR regions derived from a non-human species, such as mouse, that have, for example, been engrafted, along with any necessary framework back-mutations, into human sequence-derived V regions. Thus, for the most part, humanized antibodies are human immunoglobulins (recipient antibody) in which residues from a hypervariable region of the recipient are replaced by residues from a hypervariable region of a non-human species (donor antibody) such as mouse, rat, rabbit or non-human primate having the desired specificity, affinity, and capacity. See, for example, U.S. Pat. Nos. 5,225,539; 5,585,089; 5,693,761; 5,693,762; 5,859,205, each herein incorporated by reference. In some instances, framework residues of the human immunoglobulin are replaced by corresponding non-human residues. Furthermore, humanized antibodies may comprise residues that are not found in the recipient antibody or in the donor antibody. These modifications are made to further refine antibody performance (e.g., to obtain desired affinity). In general, the humanized antibody will comprise substantially all of at least one, and typically two, variable domains, in which all or substantially all of the hypervariable regions correspond to those of a non-human immunoglobulin and all or substantially all of the framework regions are those of a human immunoglobulin sequence. The humanized antibody optionally comprises at least a portion of an immunoglobulin constant region (Fc), typically that of a human immunoglobulin. For further details see Jones, Peter T., et al. "Replacing the complementarity-determining regions in a human antibody with those from a mouse." Nature 321.6069 (1986): 522-525.; Riechmann, Lutz, et al. "Reshaping human antibodies for therapy." Nature 332.6162 (1988): 323-327.; and Presta, Leonard G. "Antibody engineering." Current Opinion in Structural Biology 2.4 (1992): 593-596., each incorporated herein by reference.

Fully human antibodies (human antibodies) comprise human derived CDRs, i.e. CDRs of human origin. Preferably, a fully human antibody according to the current invention is an antibody having at least 90%, 91%, 92%, 93%, 94%, 95%, 96%, 97%, 98%, 99%, 99.5% or 100% sequence identity with the closest human VH germline gene (e.g. sequence extracted from recommended list and analyzed in IMGT/Domain-gap-align).

As accepted by usual nomenclature systems such as the INN species subsystem in force until 2017, fully human antibodies may comprise a low number of germline deviations compared with the closest human germline reference determined based on the IMGT database (www.imgt.org, Nov. 29, 2019). For example, a fully human antibody according to the current invention may comprise up to 1, 2, 3, 4, 5, 6, 7, 8, 9, 10, 12, 13, 14 or 15 germline deviations in the CDRs compared with the closest human germline reference. Fully human antibodies can be developed from human derived B cells by cloning techniques in combination with a cell enrichment or immortalization step. The majority of fully human antibodies in clinical use, however, were isolated either from immunized mice transgenic for the human IgG locus or from sophisticated combinatorial libraries by phage display (Bruggemann, Marianne, et al. "Human antibody production in transgenic animals." Archivum immunologiae et therapiae experimentalis 63.2 (2015): 101-108.; Carter, Paul J. "Potent antibody therapeutics by design." Nature reviews immunology 6.5 (2006): 343-357.; Frenzel, André, Thomas Schirrmann, and Michael Hust. "Phage display-derived human antibodies in clinical development and therapy." MAbs. Vol. 8. No. 7. Taylor & Francis, 2016.; Nelson, Aaron L., Eugen Dhimolea, and Janice M. Reichert. "Development trends for human monoclonal antibody therapeutics." Nature reviews drug discovery 9.10 (2010): 767-774.).

Several techniques are available to generate fully human antibodies or to generate antibodies comprising human derived CDRs (cf. WO2008112640). Cambridge Antibody Technologies (CAT) and Dyax have obtained antibody cDNA sequences from peripheral B cells isolated from immunized humans and devised phage display libraries for the identification of human variable region sequences of a particular specificity. Briefly, the antibody variable region sequences are fused either with the Gene III or Gene VIII structure of the M13 bacteriophage. These antibody variable region sequences are expressed either as Fab or single chain Fv (scFv) structures at the tip of the phage carrying the respective sequences. Through rounds of a panning process using different levels of antigen binding conditions (stringencies), phages expressing Fab or scFv structures that are specific for the antigen of interest can be selected and isolated. The antibody variable region cDNA sequences of selected phages can then be elucidated using standard sequencing procedures. These sequences may then be used for the reconstruction of a full antibody having the desired isotype using established antibody engineering techniques. Antibodies constructed in accordance with this method are considered fully human antibodies (including the CDRs). In order to improve the immunoreactivity (antigen binding affinity and specificity) of the selected antibody, an in vitro maturation process can be introduced, including a combinatorial association of different heavy and light chains, deletion/addition/mutation at the CDR3 of the heavy and light chains (to mimic V-J, and V-D-J recombination), and random mutations (to mimic somatic hypermutation). An example of a "fully human" antibody generated by this method is the anti-tumor necrosis factor α antibody, Humira (adalimumab). The term "polynucleotide" refers to a recombinantly or synthetically produced polymeric desoxyribonucleotide or analog thereof, or a modified polynucleotide. The term comprises double and single stranded DNA or RNA. The polynucleotide can be integrated e.g. into minicircles, plasmids, cosmids, minichromosomes, or artificial chromosomes. The polynucleotide can be isolated or integrated in another nucleic acid molecule, e.g. in an expression vector or chromosome of a eukaryotic host cell. The term "vector", as used herein, refers to a nucleic acid molecule capable of propagating a nucleic acid molecule to which it is linked. The term further comprises plasmids (non-viral) and viral vectors. Certain vectors are capable of directing the expression of nucleic acids or polynucleotides to which they are operatively linked. Such vectors are referred to herein as "expression vectors". Expression vectors for eukaryotic use can be constructed by inserting a polynucleotide sequence encoding at least one protein of interest (POI) into a suitable vector backbone. The vector backbone can comprise the necessary elements to ensure maintenance of the vector and, if desirable, to provide amplification within the host. For viral vectors, e.g. lentiviral or retroviral vectors, further virus specific elements such as structural elements or other elements can be required and are well known in the art. These elements can be for instance provided in cis (on the same plasmid) or in trans (on a separate plasmid). Viral vectors may require helper viruses or packaging lines for large-scale transfection. Vectors may contain further elements such as e g enhancer elements (e.g. viral, eukaryotic), introns, and viral origins of plasmid replication for replication in mammalian cells. According to the current invention, expression vectors typically have a promoter sequence that drives expression of the POI. Expression of the POI and/or selective marker protein may be constitutive or regulated (e.g. inducible by addition or removal of small molecule inductors). Preferred regulatory sequences for mammalian host cell expression include viral elements that direct high levels of expression of a POI in mammalian cells, such as regulatory elements, promoters and/or enhancers derived from cytomegalovirus (CMV), Simian Virus 40 (SV40), adenovirus, (e.g., the adenovirus major late promoter Ad LP) or polyoma. For further description of viral regulatory elements, and sequences thereof, see e.g., U.S. Pat. Nos. 5,168,062, 4,510,245 and 4,968,615.

The term "linker" or "spacer" as used herein refers to any molecule enabling a direct topological connection between two moieties. A moiety may be inter alia a polypeptide, a protein, an antibody, an antibody fragment, a cytotoxic moiety, a binding moiety, a moiety for detection such as a fluorophore, a moiety for immobilization or retrieval such as beads or magnetic beads, a reactive moiety, or any other molecule. The two moieties may be of the same type or different. Linkers may be part of conjugates and may even contribute to their function. For instance, for a conjugate comprising a polypeptide and a biotin, the presence of a spacer of approximately 4 Å (~5 atoms) between the carboxy group of the biotin and the 1st bulky amino acid of the peptide allows the biotin to reach the (strept)avidin binding pocket. Various linkers are known in the art and can be selected based on the moieties which shall be connected. The linker length typically ranges between 4 atoms and more than 200 atoms. Linkers exceeding 60 atoms in length generally comprise a population of compounds having an average length.

"Linkers for polypeptides" may be attached through an amide linkage or any other functional residue. Linkers for polypeptides may be attached N-terminal or C-terminal of the polypeptide or may be attached via a reactive functional group or amino acid side chain. Polypeptides may be coupled for example to biotin, proteins such as human serum albumin (HSA), carrier proteins such as keyhole limpet hemocyanin (KLH), ovalbumin (OVA) or bovine serum albumin (BSA), fluorescent dyes, short amino acid sequences such as Flag tag, HA tag, Myc tag or His tag, reactive tags such as maleimides, iodoacetamides, alkyl halides, 3-mercaptopropyl or 4-azidobutyric acid, or to various further suitable moieties. Non-limiting examples for suitable linkers, e.g. for conjugation of polypeptides, include beta-alanine, 4-aminobutyric acid (GABA), (2-aminoethoxy) acetic acid (AEA), 5-aminovaleric acid (Ava), 6-aminohexanoic acid (Ahx), PEG2 spacer (8-amino-3,6-dioxaoctanoic acid), PEG3 spacer (12-amino-4,7,10-trioxadodecanoic acid), PEG4 spacer (15-amino-4,7,10,13-tetraoxapenta-decanoic acid), and Ttds (Trioxatridecansuccinamic acid). In some cases, the linker may be derived from a reactive moiety, e.g. maleimides, iodoacetamides, alkyl halides, 3-mercaptopropyl or 4-azidobutyric acid. In some cases, the linker may comprise polyethylene glycol (PEG), polypropylene glycol, polyoxyalkylenes, or copolymers of polyethylene glycol or polypropylene glycol.

"Linkers for antibodies" are linkers establishing a covalent connection between different antibody portions and include peptide linker and non-proteinaceous polymers, including but not limited to polyethylene glycol (PEG), polypropylene glycol, polyoxyalkylenes, or copolymers of polyethylene glycol, polypropylene glycol.

"Treating" a disease in a subject or "treating" a subject having a disease refers to subjecting the subject to a pharmaceutical treatment, e.g., the administration of a drug, such that at least one symptom of the disease is decreased or prevented from worsening.

The terms "prevent", "preventing", "prevention" and the like refer to reducing the probability of developing a disease, disorder, or condition in a subject, who does not have, but is at risk of or susceptible to developing a disease, disorder, or condition.

The term "effective amount" or "therapeutically effective amount" are used interchangeably herein and refer to an amount sufficient to achieve a particular biological result or to modulate or ameliorate a symptom in a subject, or the time of onset of a symptom, typically by at least about 10%; usually by at least about 20%, preferably at least about 30%, or more preferably at least about 50%. Efficacy of the use of an antibody in cancer therapy can be assessed based on the change in tumor burden. Both tumor shrinkage (objective response) and time to the development of disease progression are important endpoints in cancer clinical trials. Standardized response criteria, known as RECIST (Response Evaluation Criteria in Solid Tumors), were published in 2000. An update (RECIST 1.1) was released in 2009. RECIST criteria are typically used in clinical trials where objective response is the primary study endpoint, as well as in trials where assessment of stable disease, tumor progression or time to progression analyses are undertaken because these outcome measures are based on an assessment of anatomical tumor burden and its change over the course of the trial. An effective amount for a particular subject may vary depending on factors such as the condition being treated, the overall health of the subject, the method, route, and dose of administration and the severity of side effects.

When in combination, an effective amount is in ratio to a combination of components and the effect is not limited to individual components alone.

If not defined otherwise, "Complete Response" (CR) is defined as disappearance of all target lesions. Any pathological lymph nodes (whether target or non-target) must have reduction in short axis to <10 mm. For "Partial Response" (PR) at least a 30% decrease in the sum of diameters of target lesions has to be reached, taking as reference the baseline sum diameters. For "Progressive Disease" (PD) at least a 20% increase in the sum of diameters of target lesions, taking as reference the smallest sum on study (this includes the baseline sum if that is the smallest on study). In addition to the relative increase of 20%, the sum must also demonstrate an absolute increase of at least 5 mm. In "Stable Disease" (SD) neither sufficient shrinkage to qualify for PR nor sufficient increase to qualify for PD is observed, taking as reference the smallest sum diameters while on study.

Secondary outcome measures that can be used to determine the therapeutic benefit of the inventive antibodies described herein include the following: "Objective Response Rate" (ORR) is defined as the proportion of subjects who achieve a complete response (CR) or partial response (PR). "Progression Free Survival" (PFS) is defined as the time from the first dose date of an antibody to either disease progression or death, whichever occurs first. "Overall Survival" (OS) is defined as the length of time from either the date of diagnosis or the start of treatment for a disease, that patients diagnosed with the disease are still alive. "Duration of Overall Response" (DOR) is defined as the time from the participant's initial CR or PR to the time of disease progression. "Depth of Response" (DpR) is defined as the percentage of tumor shrinkage observed at the maximal response point compared to baseline tumor load. Clinical endpoints for both ORR and PFS can be determined based on RECIST 1.1 criteria described above.

Where non-human subjects are analyzed, the aforementioned parameters to determine therapeutic efficacy and benefit have to be adapted as discussed elsewhere herein, cf. example 12 ff.

Typical "subjects" according to the current invention include human and non-human subjects. Subjects can be mammals such as mice, rats, cats, dogs, primates and/or humans.

"Pharmaceutical compositions" (also "therapeutic formulations") of the antibody, fragment or conjugate can be prepared by mixing the antibody having the desired degree of purity with optional physiologically acceptable carriers, excipients or stabilizers, e.g. according to Remington's Pharmaceutical Sciences (18th ed.; Mack Pub. Co.: Eaton, Pa., 1990), e.g. in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as Tween®, Pluronic® or polyethylene glycol (PEG).

A "host cell" is a cell that is used to receive, maintain, reproduce and amplify a vector. A host cell also can be used to express the polypeptide, e.g. an antibody or fragment thereof encoded by the vector. The nucleic acid contained in the vector is replicated when the host cell divides, thereby amplifying the nucleic acids. Preferred host cells are mammalian cells, such as CHO cells or HEK cells. Further preferred host cells are rat myeloma YB2/0 cell.

A "cell with endogenous target expression" is a cell which expresses a target protein at a level which is comparable to the physiological or diseased situation. Typically, cells which have been engineered for overexpression express a target protein at much higher levels.

The term "intra-tumoral", "intratumoral", "tumor infiltrating" or "tumoral" in the context of cells, structures, proteins, antibodies, or markers refers to their localization within the tumor tissue. Cells which are "positive" or "+" for a certain marker or protein are cells characterized by substantial expression of that marker or protein. Marker or protein expression can be determined and quantified as known in the art, e.g. to define different cell populations. For the characterization of (immune) cell populations, the marker expression can be determined by FACS or using any other technique described herein.

"Leukocytes" are immune cells expressing CD45. "CD45+ cells", as used herein, refer to all leukocytes. CD45 can be used as a marker to distinguish immune cells and non-immune cells.

The term "lymphocyte" refers to all immature, mature, undifferentiated, and differentiated white lymphocyte populations, including tissue specific and specialized varieties. It encompasses, by way of non-limiting example, B cells, T cells, NKT cells, and NK cells. In some embodiments, lymphocytes include all B cell lineages including pre-B cells, progenitor B cells, early pro-B cells, late pro-B cells, large pre-B cells, small pre-B cells, immature B cells, mature B cells, plasma B cells, memory B cells, B-1 cells, B-2 cells, and anergic AN1/T3 cell populations.

"T cells" are immune cells expressing TCRαβ, CD3, and CD8 or CD4. As used herein, the term includes naive T cells, CD4+ T cells, CD8+ T cells, regulatory T cells, memory T cells, activated T cells, anergic T cells, tolerant T cells, chimeric B cells, and antigen-specific T cells and further T cell populations known in the art. In some embodiments, the presence of a T cell receptor (TCR) on the cell surface distinguishes T cells from other lymphocytes.

"CD8+ T cells" (also "cytotoxic T cell", "TC", "cytotoxic T lymphocyte", "CTL", "T-killer cell", "cytolytic T cell", "CD8+ T-cell" or "killer T cell") are T cells expressing CD3, CD45 and CD8. CD8+ T cells can kill cancer cells, cells that are infected (particularly with viruses), or otherwise damaged cells. "CD4+ T cells" (also "T helper cells", "Th cells") are immune cells expressing CD3, CD4 and CD45. There are several subsets of T helper cells, such as, without limitation, Th1, Th2, and Th17. CD4+ T cells help suppress or regulate immune responses. They are essential in B cell antibody class switching, in the activation and growth of cytotoxic T cells, and in maximizing bactericidal activity of phagocytes such as macrophages.

As used herein, the term "Treg cells" (also "Tregs", "regulatory T cells", "T regulatory cells", "suppressor T cells") refers to immune cells expressing CD3, CD4, CD45, and FoxP3, and furthermore expressing high levels of CD25 and low levels of CD127. Identification of Treg cells may be performed as described elsewhere herein. Treg cells typically also express high levels of CTLA-4, GITR, and LAG-3. In the literature, Tregs have furthermore been classified based on memory marker CD45RO.

Under physiological conditions, Treg cells maintain immunological tolerance. During an immune response, Treg cells stop T cell-mediated immunity and suppress auto-reactive T cells that have escaped negative selection within the thymus. Treg cells can also suppress other types of immune cells such as NK cells and B cells. Adaptive Treg cells (called Th3 or Tr1 cells) are thought to be generated during an immune response.

Treg cells furthermore play an important role in immune escape by suppressing antitumor immunity, thereby providing an environment of immune tolerance. T cells that recognize cancer cells are often present in large numbers in tumors, but their cytotoxic function is suppressed by nearby immune-suppressor cells. Tregs are abundant in many different cancers, are highly enriched in the tumor microenvironment, and are well known for their role in tumor progression.

"Activated Treg cells" express CD4, CD45, FoxP3, CD69 and CCR8, and furthermore have a high expression of CD25, and have a low expression of CD127. CD69 is a T cell activation marker.

"CCR8 positive regulatory T cells" or "CCR8+ regulatory T cells" are Tregs expressing CCR8. "CD4conv cells" are conventional CD4+, CD25− T cells.

"Gamma delta T cells" are T cells that express a distinctive T-cell receptor, TCRγδ, on their surface. Gamma delta T cells also express CD3.

"B cells" are immune cells expressing CD19, and mature B cells express CD20 and CD22. B cells upon activation via CD40 undergo differentiation where somatic hypermutation and enhanced immunoglobulin class switch occur resulting in mature B cells or plasma cells (capable of secreting Abs). B cells are involved in humoral immunity of the adaptive immune system, and are antigen presenting cells.

"Macrophages" are immune cells expressing low CD14, high CD16, CD11b, CD68, CD163, and CD206. Macrophages engulf and digest cellular debris, foreign substances, microbes or cancer cells by phagocytosis. Besides phagocytosis, macrophages play a critical role in innate immunity and also help initiate adaptive immunity by recruiting other immune cells. For example, macrophages are important as antigen presenters to T cells. Macrophages that encourage inflammation are called M1 macrophages, whereas those that decrease inflammation and encourage tissue repair are called M2 macrophages.

As used herein, "M1 macrophages" are a subset of macrophages expressing ACOD1. M1 macrophages have pro-inflammatory, bactericidal, and phagocytic functions.

As used herein, "M2 macrophages" are a subset of macrophages expressing MRC1 (CD206). M2 macrophages secrete anti-inflammatory interleukins, play a role in wound healing and are needed for revascularization and reepithelialization. Tumor-associated macrophages are mainly of the M2 phenotype and seem to actively promote tumor growth.

"Dendritic Cells" (DCs) are bone marrow derived leukocytes and are the most potent type of antigen-presenting cells. DCs are specialized to capture and process antigens, converting proteins to peptides that are presented on major histocompatibility complex (MHC) molecules recognized by T cells. As defined herein, DCs are characterized by expression of CD1c, CD14, CD16, CD141, CD11c and CD123. Different subpopulations of Dendritic cells exist. In human, DC1 are immunogenic while DC2 cells are tolerogenic.

Mature DC express CD83, while plasmacytoid DC express CD123. "NK cells" (also natural killer cells) are immune cells which express CD45, CD16, CD56, NKG2D, but are CD3 negative. NK cells do not require activation to kill cells that are missing "self" markers of MHC class 1. NCR1 (also referred to as CD335 or NKp46) is expressed on NK cells and on a subset of NKT cells.

"Natural killer T (NKT) cells" are a heterogeneous group of T cells that share properties of both T cells and natural killer cells.

"iNKT cells" (also "invariant natural killer T cells") express invariant αβ TCR (Vα24-Jα18, CD24lo), CD44hi, NK1.1 (mouse), and NKG2D. The invariant TCR recognizes glycolipid antigen presented by non-polymorphic MHC class I-like molecule, CD1d. These cells can influence an immune response by rapidly producing large amounts of cytokines, i.e. IFNg.

As known in the art, "effector cells" are immune cells that actively support immune response after stimulation. As used herein, effector cells refer to immune cells expressing Fcγ receptors and are therefore able to mediate ADCC or ADCP. Non-limiting examples of effector cells are monocytes, neutrophils, mast cells, and, preferably, macrophages, and natural killer cells.

"Tertiary lymphoid structures" are intra-tumoral structures characterized by increased expression of LTta, LTtb, Cxcr5 and Cxcl13.

The term "chimeric antigen receptor" or "CAR" as used herein, refers to an artificial T cell surface receptor that is engineered to be expressed on an immune effector cell and specifically bind an antigen. CARs may be used as a therapy with adoptive cell transfer. Monocytes are removed from a patient (blood, tumor or ascites fluid) and modified so that they express the receptors specific to a particular form of antigen. In some embodiments, the CARs have been expressed with specificity to a tumor associated antigen. CARs may also comprise an intracellular activation domain, a transmembrane domain and an extracellular domain comprising a tumor associated antigen binding region. In some aspects, CARs comprise fusions of single-chain variable fragments (scFv) derived monoclonal antibodies, fused to CD3-zeta transmembrane and intracellular domain. The specificity of CAR designs may be derived from ligands of receptors (e.g., peptides). In some embodiments, a CAR can target cancers by redirecting a monocyte/macrophage expressing the CAR specific for tumor associated antigens.

Dosing schemes are abbreviated as known in the art, e.g. every day (QD), every 2 days (Q2D), or every 3 days (Q3D).

EMBODIMENTS

Antigens and Antibodies Binding Chemokine Receptors

Aspect 1—Antigen

According to a first aspect there is provided an isolated sulfated polypeptide comprising the tyrosine rich domain (TRD) of a seven transmembrane receptor. A tyrosine rich domain is a conserved, N terminal domain, which characterizes seven transmembrane receptors such as CXC and CC chemokine receptors, cf. example 1. As used herein, the term TRD refers to the amino acid or protein sequence of a CXC or CC chemokine receptor which is located N terminal of the first cysteine counted from the N terminus. Besides tyrosine, a TRD typically comprises negatively charged amino acid residues such as aspartic acid. The TRDs for all CC and CXC chemokine receptors are listed in example 4, Table 4.1 for mouse, monkey and human.

Tyrosine sulfation is a ubiquitous posttranslational protein modification which occurs in all multicellular organisms. It is catalyzed by tyrosylprotein sulfotransferases (TPSTs) 1 and 2, Golgi-resident enzymes which transfer sulfate from the cofactor PAPS (3'-phosphoadenosine 5'-phosphosulfate) to a context-dependent tyrosine in a protein substrate. Currently, only a small fraction of sulfated proteins is known and the understanding of the biological sulfation mechanisms and specific modification positions is still in progress, cf. example 4. While post-translational modifications, such as glycosylation, phosphorylation, acylation, adenylation, farnesylation, ubiquitination, and sulfation are frequent in proteins of living systems, antibody generation is typically performed based on the unmodified target sequence.

The inventors developed an unusual approach for antibody generation, and surprisingly found that the synthetically sulfated polypeptides according to the first aspect could be used to increase both, the success rates for antibody generation for chemokine receptors per se, and also the success rates for chemokine receptor antibodies with superior functional properties for therapeutic uses, as discussed elsewhere herein. The increased success rate for highly specific chemokine receptor antibodies was particularly surprising, because research antibodies which are designed for the sequence independent detection of sulfated tyrosine as a post-translational modification are rare.

The seven transmembrane receptor may be from any species expressing chemokine receptors characterized by a TRD, e.g. human, monkey, *Macaca fascicularis* (cynomolgus monkey), *Macaca mulatta* (*Rhesus macaque*), rodent, mouse, rat, horse, bovine, pig, dog, cat and camel.

According to some first embodiments of the first aspect, there is provided an isolated polypeptide, wherein the isolated polypeptide comprises the tyrosine rich domain (TRD) of a seven transmembrane receptor, further characterized in that at least 25%, at least 50%, or at least 75% of the tyrosine residues of the TRD are sulfated.

For example, in a highly successful antibody campaign, the TRD of human or cynomolgus CCR8 was sulfated at positions Y3, Y15 and Y17, while Y16 was omitted, i.e. 75% of tyrosines in the TRD were sulfated (Table 6.1). In another example, the TRD of human CCR4 was sulfated at positions 19 and 22 and was used for off-target binding, i.e. 50% of the tyrosines were sulfated (Table 8.1). In yet another approach, the TRD of murine CCR4 was sulfated at position 22 and used for off target binding, i.e. 25% of tyrosines in the TRD were sulfated (Table 6.1).

Table 4.1 shows a list of sulfated peptides including the preferred positions for tyrosine sulfations. Without being bound by theory, the inventors believe that the introduction of additional charges in the form of tyrosine sulfations tailors the antibody to recognize a specific pattern of negative charges. This recognition seems to require an increased percentage of tyrosines and positively charged amino acids, at least in the HCDR3 of the antibody, i.e., the use of the isolated sulfated polypeptides according to the current invention also influenced the structural composition of the antibodies and in particular the amino acid composition of the HCDR3, cf. example 9.

According to some second embodiments of the first aspect, which may be or may not be the same as the first embodiments according to the first aspect, there is provided an isolated polypeptide, wherein the seven transmembrane receptor is human, cynomolgus or mouse.

In some of these second embodiments the seven transmembrane receptor is murine. In some preferred of these second embodiments the seven transmembrane receptor is human and/or cynomolgus. In some preferred of these second embodiments the seven transmembrane receptor is human. In some of these second embodiments the seven transmembrane receptor is cynomolgus.

According to some third embodiments of the first aspect, which may be or may not be the same as the first and/or second embodiments according to the first aspect, there is provided an isolated polypeptide, wherein the seven transmembrane receptor is a chemokine receptor, preferably
 a) a CC chemokine receptor such as CCR1, CCR2, CCR3, CCR4, CCR5, CCR6, CCR7, CCR8, CCR9 or CCR10,
 b) a CXC chemokine receptor such as CXCR1, CXCR2, CXCR3, CXCR4, CXCR5, or CXCR6, or
 c) CX3CR1 or CXCR1.

In some of these third embodiments, the seven transmembrane receptor is a CC chemokine receptor or a CXC chemokine receptor. In some of these third embodiments, the seven transmembrane receptor is a CC chemokine receptor, such as CCR1, CCR2, CCR3, CCR4, CCR5, CCR6, CCR7, CCR8, CCR9 or CCR10.

In some preferred of these third embodiments, the seven transmembrane receptor is CCR8 or CCR4. In some highly preferred of these third embodiments, the seven transmembrane receptor is CCR8. In some of these third embodiments, the seven transmembrane receptor is a CXC chemokine receptor, such as CXCR1, CXCR2, CXCR3, CXCR4, CXCR5, or CXCR6. In some of these third embodiments, the seven transmembrane receptor is CX3CR1 or CXCR1.

In some preferred embodiments of the first aspect, there is provided an isolated polypeptide which comprises the TRD of a human or cynomolgus seven transmembrane receptor, further characterized in that at least 25%, at least 50%, or at least 75% of the tyrosine residues of the TRD are sulfated, wherein the seven transmembrane receptor is a CC chemokine receptor or a CXC chemokine receptor, and preferably, wherein the seven transmembrane receptor is CCR8 or CCR4.

According to some embodiments A of the third embodiments of the first aspect, the isolated sulfated polypeptide comprises a sequence according to or having at least 90%, 95% or 98% sequence identity with
 a) SEQ ID NO:1 (CCR1_HUMAN_TRD), preferably wherein at least Y10 and/or Y18 have been sulfated, or
 b) SEQ ID NO:7 (CCR2_HUMAN_TRD), preferably wherein at least Y26 has been sulfated, or
 c) SEQ ID NO:13 (CCR3_HUMAN_TRD), preferably wherein Y16 and/or Y17 have been sulfated, or
 d) SEQ ID NO:19 (CCR4_HUMAN_TRD), preferably wherein at least Y22 has been sulfated and preferably furthermore Y16, Y19 and/or Y20 have been sulfated, or
 e) SEQ ID NO:25 (CCR5_HUMAN_TRD), preferably wherein two, three or all of Y3, Y10, Y14 and Y15 have been sulfated, or
 f) SEQ ID NO:31 (CCR6_HUMAN_TRD), preferably wherein at least two or three of Y18, Y26 and Y27 have been sulfated, or
 g) SEQ ID NO:37 (CCR7_HUMAN_TRD), preferably wherein one or both of Y8 and Y17 have been sulfated, or
 h) SEQ ID NO:43 (CCR8_HUMAN_TRD), preferably wherein at least two or all of Y3, Y15 and Y17 have been sulfated, or i) SEQ ID NO:61 (CCR9_HUMAN_TRD), wherein at least Y28 and preferably also Y17 and/or Y37 have been sulfated, or
j) SEQ ID NO:67 (CCR10_HUMAN_TRD), preferably wherein at least one or both of Y14 and Y22 have been sulfated, or
k) SEQ ID NO:73 (CXCR1_HUMAN_TRD), preferably wherein Y27 has been sulfated, or
l) SEQ ID NO:79 (CXCR2_HUMAN_TRD), preferably wherein Y23 and/or Y25 have been sulfated, or
m) SEQ ID NO:85 (CXCR3_HUMAN_TRD), preferably wherein at least one or both of Y27 and Y29 have been sulfated, or
n) SEQ ID NO:91 (CXCR4_HUMAN_TRD), preferably wherein at least Y12 and/or Y21 have been sulfated, or
o) SEQ ID NO:97 (CXCR5_HUMAN_TRD), preferably wherein at least one of Y3 and Y27 have been sulfated, or
p) SEQ ID NO:103 (CXCR6_HUMAN_TRD), preferably wherein at least one or both of Y6 and Y10 has been sulfated, or
q) SEQ ID NO:157 (CX3CR1_HUMAN_TRD), preferably wherein at least Y14 has been sulfated, or
r) SEQ ID NO:163 (CXCR1_HUMAN_TRD), preferably wherein at least Y27 has been sulfated.

According to some embodiments B of the third embodiments of the first aspect, the isolated sulfated polypeptide comprises a sequence according to or having at least 90%, 95% or 98% sequence identity with
a) SEQ ID NO:3 (CCR1_MOUSE_TRD), preferably wherein at least Y10 and/or Y18 have been sulfated, or
b) SEQ ID NO:9 (CCR2_MOUSE_TRD), preferably wherein at least Y37 and/or Y39 has been sulfated, or
c) SEQ ID NO:15 (CCR3_MOUSE_TRD), preferably wherein Y20 and/or Y22 has been sulfated, or
d) SEQ ID NO:21 (CCR4_MOUSE_TRD), preferably wherein at least Y22 has been sulfated and preferably furthermore Y16, Y19 and/or Y20 have been sulfated, or
e) SEQ ID NO:27 (CCR5_MOUSE_TRD), preferably wherein two or three of Y10, Y12 and Y16 have been sulfated, or
f) SEQ ID NO:33 (CCR6_MOUSE_TRD), preferably wherein at least two or three of Y13, Y18 and Y19 have been sulfated,
g) SEQ ID NO:39 (CCR7_MOUSE_TRD), preferably wherein one or both of Y8 and Y17 and optionally Y20 have been sulfated have been sulfated, or
h) SEQ ID NO:45 (CCR8MOUSE_TRD), preferably wherein at least two or all of Y3, Y14 and Y15 have been sulfated, or
i) SEQ ID NO:63 (CCR9_MOUSE_TRD), preferably wherein at least Y28 has been sulfated, and preferably also Y19 has been sulfated, or
j) SEQ ID NO:69 (CCR10_MOUSE_TRD), preferably wherein at least one, two or all of Y14, Y17 and Y22 has been sulfated, or
k) SEQ ID NO:75 (CXCR1_MOUSE_TRD), preferably wherein at least Y6 has been sulfated, or
l) SEQ ID NO:81 (CXCR2_MOUSE_TRD), preferably wherein Y24 has been sulfated, or
m) SEQ ID NO:87 (CXCR3_MOUSE_TRD), preferably wherein at least one or both of Y27 and Y29 have been sulfated, or
n) SEQ ID NO:93 (CXCR4_MOUSE_TRD), preferably wherein Y23, Y13 and/or Y14 have been sulfated, or
o) SEQ ID NO:99 (CXCR5_MOUSE_TRD), preferably wherein at least Y3 and/or Y14 and/or Y20 and/or Y26 have been sulfated, or
p) SEQ ID NO:105 (CXCR6_MOUSE_TRD), preferably wherein at least one or both of Y11 and Y15 have been sulfated, or
q) SEQ ID NO:159 (CX3CR1_MOUSE_TRD), preferably wherein at least Y15 has been sulfated, or
r) SEQ ID NO:165 (CXCR1_MOUSE_TRD), preferably wherein at least Y6 has been sulfated.

According to some embodiments C of the third embodiments of the first aspect, the isolated sulfated polypeptide comprises a sequence according to or having at least 90%, 95% or 98% sequence identity with
a) SEQ ID NO:2 (CCR1_MACFA_TRD), preferably wherein at least Y10 and/or Y18 have been sulfated, or
b) SEQ ID NO:8 (CCR2_MACMU_TRD), preferably wherein at least Y26 has been sulfated, or
c) SEQ ID NO:14 (CCR3_MACFA_TRD), preferably wherein Y16 has been sulfated, or
d) SEQ ID NO:20 (CCR4MACFA_TRD), preferably wherein at least Y22 has been sulfated and preferably furthermore Y16, Y19 and/or Y20 have been sulfated, or
e) SEQ ID NO:26 (CCR5_MACMU_TRD), preferably wherein two, three or all of Y3, Y10, Y14 and Y15 have been sulfated, or
f) SEQ ID NO:32 (CCR6_MACFA_TRD), preferably wherein at least two or three of Y23, Y31 and Y32 have been sulfated, or
g) SEQ ID NO:38 (CCR7_MACFA_TRD), preferably wherein one or both of Y8 and Y17 have been sulfated, or
h) SEQ ID NO:44 (CCR8_MACFA_TRD), preferably wherein at least two or all of Y3, Y15 and Y17 have been sulfated, or
i) SEQ ID NO:62 (CCR9_MACFA_TRD), preferably wherein at least Y28, and preferably also Y17 and/or Y37 has been sulfated, or
j) SEQ ID NO:68 (CCR10_MACFA_TRD), preferably wherein at least one or both of Y14 and Y22 has been sulfated, or
k) SEQ ID NO:74 (CXCR1_MACFA_TRD), preferably wherein at least one of Y14 and Y28 has been sulfated, or
l) SEQ ID NO:80 (CXCR2_MACFA_TRD), preferably wherein Y20 and/or Y22 have been sulfated, or
m) SEQ ID NO:86 (CXCR3_MACFA_TRD), preferably wherein at least one or both of Y27 and Y29 have been sulfated, or
n) SEQ ID NO:92 (CXCR4_MACFA_TRD), preferably wherein at least Y12 and/or Y21 have been sulfated, or
o) SEQ ID NO:98 (CXCR5_MACFA_TRD), preferably wherein at least one of Y3 and Y27 have been sulfated, or
p) SEQ ID NO:104 (CXCR6_MACFA_TRD), preferably wherein at least two or all of Y4, Y7 and Y39 have been sulfated, or
q) SEQ ID NO:158 (CX3CR1_MACFA_TRD), preferably wherein at least Y20 has been sulfated, or
r) SEQ ID NO:164 (CXCR1 MACMU TRD), preferably wherein at least Y14 has been sulfated.

In some fourth embodiments of the first aspect, which may be or may not be the same as the first, second and/or third embodiments according to the first aspect, the isolated polypeptide comprises the N terminus of the seven transmembrane receptor including TRD and LID domain, preferably wherein at least the cysteine between the TRD and the LID domain has been removed or has been altered into a different amino acid.

The extracellular domains of chemokine receptors can be structured into four regions:
(i) an N-terminal domain which can be subdivided into
  (a) the membrane-distal tyrosine-rich domain (TRD),
  (b) a cysteine, and
  (c) a LID domain,
(iii) an extracellular domain 1 (ECL1),
(iii) an extracellular domain 2 (ECL2), and
(iv) an extracellular domain 3 (ECL3).

Some of the polypeptides according to the current invention are difficult to handle, e.g. due to a high tendency for aggregation. Without being bound by theory, the inventors believe, that the high "stickiness" results from the increased numbers of charged amino acids and charged sulfate residues. For the polypeptides comprising the N terminus of a chemokine receptor, the aggregation properties could be ameliorated by removal or amino acid exchange of the cysteine between TRD and LID domain. Optimal results were obtained by altering the cysteine into a serine (example 5, Table 4.1).

In some of the fourth embodiments according to the first aspect, the cysteine may be omitted and TRD and LID are directly connected. In some different of the fourth embodiments according to the first aspect, the cysteine may be replaced by a different polar uncharged amino acid. In some preferred of the fourth embodiments according to the first aspect, the cysteine is replaced by a serine (cf. Table 4.1). In some of the fourth embodiments according to the first aspect, the cysteine may be replaced by at least one different amino acid.

According to some embodiments A of the fourth embodiments of the first aspect, the isolated sulfated polypeptide comprises a sequence according to or having at least 90%, 95% or 98% sequence identity with
a) SEQ ID NO:4 (CCR1_HUMAN_N term), wherein at least Y10 and/or Y18 have been sulfated,
b) SEQ ID NO:10 (CCR2_HUMAN_N term), wherein at least Y26 has been sulfated,
c) SEQ ID NO:16 (CCR3_HUMAN_N term), wherein Y16 and/or Y17 have been sulfated,
d) SEQ ID NO:22 (CCR4_HUMAN_N term), wherein at least Y22 has been sulfated and preferably furthermore Y16, Y19 and/or Y20 have been sulfated,
e) SEQ ID NO:28 (CCR5_HUMAN_N term), wherein two, three or all of Y3, Y10, Y14 and Y15 have been sulfated,
f) SEQ ID NO:34 (CCR6_HUMAN_N term), wherein at least two or three of Y18, Y26 and Y27 have been sulfated,
g) SEQ ID NO:40 (CCR7_HUMAN_N term), wherein one or both of Y8 and Y17 have been sulfated,
h) SEQ ID NO:46 (CCR8_HUMAN_N term), wherein at least two or all of Y3, Y15 and Y17 have been sulfated,
i) SEQ ID NO:64 (CCR9_HUMAN_N term), wherein at least Y28, and preferably also Y17 and/or Y37 have been sulfated,
j) SEQ ID NO:70 (CCR10_HUMAN_N term), wherein at least one or both of Y14 and Y22 have been sulfated,
k) SEQ ID NO:76 (CXCR1_HUMAN_N term), wherein Y27 has been sulfated,
l) SEQ ID NO:82 (CXCR2_HUMAN_N term), wherein Y23 and/or Y25 have been sulfated,
m) SEQ ID NO:88 (CXCR3_HUMAN_N term), wherein at least one or both of Y27 and Y29 have been sulfated,
n) SEQ ID NO:94 (CXCR4_HUMAN_N term), wherein at least Y12 and/or Y21 have been sulfated,
o) SEQ ID NO:100 (CXCR5_HUMAN_N term), wherein at least one of Y3 and Y27 have been sulfated, or
p) SEQ ID NO:106 (CXCR6_HUMAN_N term), wherein at least one or both of Y6 and Y10 have been sulfated, or
q) SEQ ID NO:160 (CX3CR1_HUMAN_N term), preferably wherein at least Y14 has been sulfated, or
r) SEQ ID NO:166 (CXCR1_HUMAN_N term), preferably wherein at least Y27 has been sulfated.

According to some embodiments B of the fourth embodiments of the first aspect, the isolated sulfated polypeptide comprises a sequence according to or having at least 90%, 95% or 98% sequence identity with
a) SEQ ID NO:6 (CCR1_MOUSE_N term), preferably wherein at least Y10 and/or Y18 have been sulfated, or
b) SEQ ID NO:12 (CCR2_MOUSE_N term), preferably wherein at least Y37 and/or Y39 has been sulfated, or
c) SEQ ID NO:18 (CCR3_MOUSE_N term), preferably wherein Y20 and/or Y22 has been sulfated, or
d) SEQ ID NO:24 (CCR4_MOUSE_N term), preferably wherein at least Y22 has been sulfated and preferably furthermore Y16, Y19 and/or Y20 have been sulfated, or
e) SEQ ID NO:30 (CCR5_MOUSE_N term), preferably wherein two or three of Y10, Y12 and Y16 have been sulfated, or
f) SEQ ID NO:36 (CCR6_MOUSE_N term), preferably wherein at least two or three of Y13, Y18 and Y19 have been sulfated,
g) SEQ ID NO:42 (CCR7_MOUSE_N term), preferably wherein one or both of Y8 and Y17 and optionally Y20 have been sulfated, or
h) SEQ ID NO:48 (CCR8_MOUSE_N term with C=X or S), preferably wherein at least two or all of Y3, Y14 and Y15 have been sulfated, or
i) SEQ ID NO:66 (CCR9_MOUSE_N term), preferably wherein at least Y28 has been sulfated, and preferably also Y19 has been sulfated, or
j) SEQ ID NO: 72 (CCR10_MOUSE_N term), preferably wherein at least one, two or all of Y14, Y17 and Y22 has been sulfated, or
k) SEQ ID NO:78 (CXCR1_MOUSE_N term), preferably wherein at least Y6 has been sulfated, or
l) SEQ ID NO:84 (CXCR2_MOUSE_N term), preferably wherein Y24 has been sulfated, or
m) SEQ ID NO:90 (CXCR3_MOUSE_N term), preferably wherein at least one or both of Y27 and Y29 have been sulfated, or
n) SEQ ID NO:96 (CXCR4_MOUSE_N term), preferably wherein at least Y23 and/or Y14 have been sulfated, or
o) SEQ ID NO:102 (CXCR5_MOUSE_N term), preferably wherein at least Y3 and/or Y14 and/or Y20 and/or Y26 have been sulfated, or
p) SEQ ID NO:108 (CXCR6_MOUSE_N term), preferably wherein at least one or both of Y11 and Y15 have been sulfated, or
q) SEQ ID NO:162 (CX3CR1_MOUSE_N term), preferably wherein at least Y15 has been sulfated, or
r) SEQ ID NO:168 (CXCR1_MOUSE_N term), preferably wherein at least Y6 has been sulfated.

According to some embodiments C of the fourth embodiments of the first aspect, the isolated sulfated polypeptide comprises a sequence according to or having at least 90%, 95% or 98% sequence identity with
a) SEQ ID NO:5 (CCR1_MACFA_N term), preferably wherein at least Y10 and/or Y18 have been sulfated, or
b) SEQ ID NO:11 (CCR2_MACMU_N term), preferably wherein at least Y26 has been sulfated, or c) SEQ ID NO:17 (CCR3_MACFA_N term), preferably wherein Y16 has been sulfated, or d) SEQ ID NO:23 (CCR4_MACFA_N term), preferably wherein at least Y22 has been sulfated and preferably furthermore Y16, Y19 and/or Y20 have been sulfated, or
e) SEQ ID NO:29 (CCR5_MACMU_N term), preferably wherein two, three or all of Y3, Y10, Y14 and Y15 have been sulfated, or
f) SEQ ID NO:35 (CCR6_MACFA_N term), preferably wherein at least two or three of Y23, Y31 and Y32 have been sulfated, or
g) SEQ ID NO:41 (CCR7_MACFA_N term), preferably wherein one or both of Y8 and Y17 have been sulfated, or
h) SEQ ID NO:47 (CCR8_MACFA_N term), preferably wherein at least two or all of Y3, Y15 and Y17 have been sulfated, or
i) SEQ ID NO:65 (CCR9_MACFA_N term), preferably wherein at least Y28, and preferably also Y17 and/or Y37 have been sulfated, or
j) SEQ ID NO:71 (CCR10_MACFA_N term), preferably wherein at least one or both of Y14 and Y22 has been sulfated, or
k) SEQ ID NO:77 (CXCR1_MACFA_N term), preferably wherein at least one of Y14 and Y28 has been sulfated, or
l) SEQ ID NO:83 (CXCR2MACFA_N term), preferably wherein Y20 and/or Y22 have been sulfated, or
m) SEQ ID NO:89 (CXCR3_MACFA_N term), preferably wherein at least one or both of Y27 and Y29 have been sulfated, or
n) SEQ ID NO:95 (CXCR4_MACFA_N term), preferably wherein at least Y12 and/or Y21 have been sulfated, or
o) SEQ ID NO:101 (CXCR5_MACFA_N term), preferably wherein at least one of Y3 and Y27 have been sulfated, or
p) SEQ ID NO:107 (CXCR6_MACFA_N term), preferably wherein at least two or all of Y4, Y7 and Y39 have been sulfated, or
q) SEQ ID NO:161 (CX3CR1_MACFA_N term), preferably wherein at least Y20 or Y22 has been sulfated, or
r) SEQ ID NO:167 (CXCR1_MACMU_N term), preferably wherein at least Y14 or Y28 has been sulfated.

In some of the fourth embodiments of the first aspect, the isolated sulfated polypeptide comprises a sequence according to
a) SEQ ID NO:4 (CCR1_HUMAN_N term), SEQ ID NO:5 (CCR1_MACFA_N term), or SEQ ID NO:6 (CCR1_MOUSE_N term), preferably wherein at least Y10 and/or Y18 have been sulfated, or
b) SEQ ID NO:10 (CCR2_HUMAN_N term), or SEQ ID NO:11 (CCR2_MACMU_N term), preferably wherein at least Y26 has been sulfated, or
c) SEQ ID NO:12 (CCR2_MOUSE_N term), preferably wherein at least Y37 and/or Y39 has been sulfated, or
d) SEQ ID NO:16 (CCR3_HUMAN_N term), preferably wherein Y16 and/or Y17 have been sulfated, or
e) SEQ ID NO:17 (CCR3_MACFA_N term), preferably wherein Y16 has been sulfated, or
f) SEQ ID NO:18 (CCR3_MOUSE_N term), preferably wherein Y20 and/or Y22 have been sulfated, or
g) SEQ ID NO:22 (CCR4_HUMAN_N term), SEQ ID NO:23 (CCR4_MACFA_N term), or SEQ ID NO:24 (CCR4_MOUSE_N term), preferably wherein at least Y22 has been sulfated and preferably furthermore Y16, Y19 and/or Y20 have been sulfated, or
h) SEQ ID NO:28 (CCR5_HUMAN_N term), or SEQ ID NO:29 (CCR5_MACMU_N term), preferably wherein two, three or all of Y3, Y10, Y14 and Y15 have been sulfated, or
i) SEQ ID NO:30 (CCR5_MOUSE_N term), preferably wherein two or three of Y10, Y12 and Y16 have been sulfated, or
j) SEQ ID NO:34 (CCR6_HUMAN_N term), preferably wherein at least two or three of Y18, Y26 and Y27 have been sulfated, or
k) SEQ ID NO:35 (CCR6_MACFA_N term), preferably wherein at least two or three of Y23, Y31 and Y32 have been sulfated, or
l) SEQ ID NO:36 (CCR6_MOUSE_N term), preferably wherein at least two or three of Y13, Y18 and Y19 have been sulfated, or
m) SEQ ID NO:40 (CCR7_HUMAN_N term), or SEQ ID NO:41 (CCR7_MACFA_N term), preferably wherein one or both of Y8 and Y17 have been sulfated, or
n) SEQ ID NO:42 (CCR7_MOUSE_N term), preferably wherein one or both of Y8 and Y17 and optionally Y20 have been sulfated have been sulfated, or
o) SEQ ID NO:46 (CCR8 HUMAN_N term with C=X or S), or SEQ ID NO:47 (CCR8_MACFA_N term with C=X or S), preferably wherein at least two or all of Y3, Y15 and Y17 have been sulfated, or
p) SEQ ID NO:48 (CCR8_MOUSE_N term with C=X or S), preferably wherein at least two or all of Y3, Y14 and Y15 have been sulfated, or
q) SEQ ID NO:64 (CCR9_HUMAN_N term), or SEQ ID NO:65 (CCR9_MACFA_N term), preferably wherein at least Y28, and preferably also Y17 and/or Y37 has been sulfated, or
r) SEQ ID NO:66 (CCR9_MOUSE_N term), preferably wherein at least Y28 has been sulfated, and preferably also Y19 has been sulfated, or
s) SEQ ID NO:70 (CCR10_HUMAN_N term), or SEQ ID NO:71 (CCR10_MACFA_N term), preferably wherein at least one or both of Y14 and Y22 has been sulfated, or
t) SEQ ID NO:72 (CCR10_MOUSE_N term), preferably wherein at least one, two or all of Y14, Y17 and Y22 has been sulfated, or
u) SEQ ID NO:76 (CXCR1_HUMAN_N term), preferably wherein Y27 has been sulfated, or
v) SEQ ID NO:77 (CXCR1_MACFA_N term), preferably wherein at least one of Y14 and Y28 has been sulfated, or
w) SEQ ID NO:78 (CXCR1_MOUSE_N term), preferably wherein at least Y6 has been sulfated, or
x) SEQ ID NO:82 (CXCR2 HUMAN_N term), preferably wherein Y23 and/or Y25 have been sulfated, or
y) SEQ ID NO:83 (CXCR2MACFA_N term), preferably wherein Y20 and/or Y22 have been sulfated, or
z) SEQ ID NO:84 (CXCR2_MOUSE_N term), preferably wherein Y24 has been sulfated, or
aa) SEQ ID NO:88 (CXCR3_HUMAN_N term), SEQ ID NO:89 (CXCR3_MACFA_N term), or SEQ ID NO:90 (CXCR3_MOUSE_N term), preferably wherein at least one or both of Y27 and Y29 have been sulfated, or
bb) SEQ ID NO:94 (CXCR4_HUMAN_N term), or SEQ ID NO:95 (CXCR4_MACFA_N term), preferably wherein at least Y12 and/or Y21 have been sulfated, or
cc) SEQ ID NO:96 (CXCR4_MOUSE_N term), preferably wherein at least Y23 and/or Y14 have been sulfated, or
dd) SEQ ID NO:100 (CXCR5_HUMAN_N term), or SEQ ID NO:101 (CXCR5_MACFA_N term), preferably wherein at least one of Y3 and Y27 have been sulfated, or
ee) SEQ ID NO:102 (CXCR5_MOUSE_N term), preferably wherein at least Y3 and/or Y14 and/or Y20 and/or Y26 have been sulfated, or ff) SEQ ID NO:106 (CXCR6_HUMAN_N term), preferably wherein at least one or both of Y6 and Y10 has been sulfated, or
gg) SEQ ID NO:107 (CXCR6_MACFA_N term), preferably wherein at least two or all of Y4, Y7 and Y39 have been sulfated, or
hh) SEQ ID NO:108 (CXCR6_MOUSE_N term), preferably wherein at least one or both of Y11 and Y15 have been sulfated, or
ii) SEQ ID NO:160 (CX3CR1_HUMAN_N term), preferably wherein at least Y14 has been sulfated, or
jj) SEQ ID NO:161 (CX3CR1_MACFA_N term), preferably wherein at least Y20 or Y22 has been sulfated, or
kk) SEQ ID NO:162 (CX3CR1_MOUSE_N term), preferably wherein at least Y15 has been sulfated, or
ll) SEQ ID NO:166 (CXCR1 HUMAN_N term), preferably wherein at least Y27 has been sulfated, or
mm) SEQ ID NO:167 (CXCR1_MACMU_N term), preferably wherein at least Y14 or Y28 has been sulfated, or
nn) SEQ ID NO:168 (CXCR1_MOUSE_N term), preferably wherein at least Y6 has been sulfated.

In some of the first, second, third or fourth embodiments of the first aspect, the isolated sulfated polypeptide comprises a sequence according to or having at least 90% sequence identity with a) SEQ ID NO:1 (CCR1_HUMAN_TRD), SEQ ID NO:4 (CCR1_HUMAN_N term), SEQ ID NO:2 (CCR1_MACFA_TRD), SEQ ID NO:5 (CCR1_MACFA_N term), SEQ ID NO:3 (CCR1_MOUSE_TRD) or SEQ ID NO:6 (CCR1_MOUSE_N term), preferably wherein at least Y10 and/or Y18 have been sulfated, or
b) SEQ ID NO:7 (CCR2_HUMAN_TRD), SEQ ID NO:10 (CCR2_HUMAN_N term), SEQ ID NO:8 (CCR2_MACMU_TRD) or SEQ ID NO:11 (CCR2_MACMU_N term), preferably wherein at least Y26 has been sulfated, or
c) SEQ ID NO:9 (CCR2_MOUSE_TRD) or SEQ ID NO:12 (CCR2_MOUSE_N term), preferably wherein at least Y37 and/or Y39 has been sulfated, or
d) SEQ ID NO:13 (CCR3_HUMAN_TRD) or SEQ ID NO:16 (CCR3_HUMAN_N term), preferably wherein Y16 and/or Y17 have been sulfated, or
e) SEQ ID NO:14 (CCR3_MACFA_TRD) or SEQ ID NO:17 (CCR3_MACFA_N term), preferably wherein Y16 has been sulfated, or
f) SEQ ID NO:15 (CCR3_MOUSE_TRD) or SEQ ID NO:18 (CCR3_MOUSE_N term), preferably wherein Y20 and/or Y22 have been sulfated, or
g) SEQ ID NO:19 (CCR4_HUMAN_TRD), SEQ ID NO:22 (CCR4_HUMAN_N term), SEQ ID NO:20 (CCR4_MACFA_TRD), SEQ ID NO:23 (CCR4_MACFA_N term), SEQ ID NO:21 (CCR4_MOUSE_TRD) or SEQ ID NO:24 (CCR4_MOUSE_N term), preferably wherein at least Y22 has been sulfated and preferably furthermore Y16, Y19 and/or Y20 have been sulfated, or
h) SEQ ID NO:25 (CCR5_HUMAN_TRD), SEQ ID NO:28 (CCR5_HUMAN_N term), SEQ ID NO:26 (CCR5_MACMU_TRD) or SEQ ID NO:29 (CCR5_MACMU_N term), preferably wherein two, three or all of Y3, Y10, Y14 and Y15 have been sulfated, or
i) SEQ ID NO:27 (CCR5_MOUSE_TRD) or SEQ ID NO:30 (CCR5_MOUSE_N term), preferably wherein two or three of Y10, Y12 and Y16 have been sulfated, or
j) SEQ ID NO:31 (CCR6_HUMAN_TRD) or SEQ ID NO:34 (CCR6_HUMAN_N term), preferably wherein at least two or three of Y18, Y26 and Y27 have been sulfated, or
k) SEQ ID NO:32 (CCR6_MACFA_TRD) or SEQ ID NO:35 (CCR6_MACFA_N term), preferably wherein at least two or three of Y23, Y31 and Y32 have been sulfated, or
l) SEQ ID NO:33 (CCR6_MOUSE_TRD) or SEQ ID NO:36 (CCR6_MOUSE_N term), preferably wherein at least two or three of Y13, Y18 and Y19 have been sulfated, or
m) SEQ ID NO:37 (CCR7_HUMAN_TRD), SEQ ID NO:40 (CCR7_HUMAN_N term), SEQ ID NO:38 (CCR7_MACFA_TRD) or SEQ ID NO:41 (CCR7_MACFA_N term), preferably wherein one or both of Y8 and Y17 have been sulfated, or
n) SEQ ID NO:39 (CCR7_MOUSE_TRD) or SEQ ID NO:42 (CCR7_MOUSE_N term), preferably wherein one or both of Y8 and Y17 and optionally Y20 have been sulfated have been sulfated, or
o) SEQ ID NO:43 (CCR8_HUMAN_TRD), SEQ ID NO:44 (CCR8_MACFA_TRD), SEQ ID NO:46 (CCR8_HUMAN_N term with C=X or S), or SEQ ID NO:47 (CCR8_MACFA_N term with C=X or S), preferably wherein at least two or all of Y3, Y15 and Y17 have been sulfated, or
p) SEQ ID NO:45 (CCR8_MOUSE_TRD) or SEQ ID NO:48 (CCR8_MOUSE_N term with C=X or S), preferably wherein at least two or all of Y3, Y14 and Y15 have been sulfated, or
q) SEQ ID NO:61 (CCR9_HUMAN_TRD), SEQ ID NO:64 (CCR9_HUMAN_N term), SEQ ID NO:62 (CCR9_MACFA_TRD) or SEQ ID NO:65 (CCR9_MACFA_N term), preferably wherein at least Y28, and preferably also Y17 and/or Y37 has been sulfated, or
r) SEQ ID NO:63 (CCR9_MOUSE_TRD) or SEQ ID NO:66 (CCR9_MOUSE_N term), preferably wherein at least Y28 has been sulfated, and preferably also Y19 has been sulfated, or
s) SEQ ID NO:67 (CCR10_HUMAN_TRD), SEQ ID NO:70 (CCR10_HUMAN_N term), SEQ ID NO:68 (CCR10_MACFA_TRD) or SEQ ID NO:71 (CCR10_MACFA_N term), preferably wherein at least one or both of Y14 and Y22 has been sulfated, or
t) SEQ ID NO:69 (CCR10_MOUSE_TRD) or SEQ ID NO:72 (CCR10_MOUSE_N term), preferably wherein at least one, two or all of Y14, Y17 and Y22 has been sulfated, or
u) SEQ ID NO:73 (CXCR1_HUMAN_TRD) or SEQ ID NO:76 (CXCR1_HUMAN_N term), preferably wherein Y27 has been sulfated, or
v) SEQ ID NO:74 (CXCR1_MACFA_TRD) or SEQ ID NO:77 (CXCR1_MACFA_N term), preferably wherein at least one of Y14 and Y28 has been sulfated, or
w) SEQ ID NO:75 (CXCR1_MOUSE_TRD) or SEQ ID NO:78 (CXCR1_MOUSE_N term), preferably wherein at least Y6 has been sulfated, or
x) SEQ ID NO:79 (CXCR2_HUMAN_TRD) or SEQ ID NO:82 (CXCR2_HUMAN_N term), preferably wherein Y23 and/or Y25 have been sulfated, or
y) SEQ ID NO:80 (CXCR2_MACFA_TRD) or SEQ ID NO:83 (CXCR2_MACFA_N term), preferably wherein Y20 and/or Y22 have been sulfated, or z) SEQ ID NO:81 (CXCR2_MOUSE_TRD) or SEQ ID NO:84 (CXCR2_MOUSE_N term), preferably wherein Y24 has been sulfated, or aa) SEQ ID NO:85 (CXCR3_HUMAN_TRD), SEQ ID NO:88 (CXCR3_HUMAN_N term), SEQ ID NO:86 (CXCR3_MACFA_TRD), SEQ ID NO:89 (CXCR3_MACFA_N term), SEQ ID NO:87 (CXCR3_MOUSE_TRD) or SEQ ID NO:90 (CXCR3_MOUSE_N term), preferably wherein at least one or both of Y27 and Y29 have been sulfated, or bb) SEQ ID NO:91 (CXCR4_HUMAN_TRD), SEQ ID NO:94 (CXCR4_HUMAN_N term), SEQ ID NO:92 (CXCR4_MACFA_TRD) or SEQ ID NO:95 (CXCR4_MACFA_N term), preferably wherein at least Y12 and/or Y21 have been sulfated, or cc) SEQ ID NO:93 (CXCR4_MOUSE_TRD) or SEQ ID NO:96 (CXCR4_MOUSE_N term), preferably wherein at least Y23 and/or Y14 have been sulfated, or dd) SEQ ID NO:97 (CXCR5_HUMAN_TRD), SEQ ID NO:100 (CXCR5_HUMAN_N term), SEQ ID NO:98 (CXCR5_MACFA_TRD) or SEQ ID NO:101 (CXCR5_MACFA_N term), preferably wherein at least one of Y3 and Y27 have been sulfated, or ee) SEQ ID NO:99 (CXCR5_MOUSE_TRD) or SEQ ID NO:102 (CXCR5_MOUSE_N term), preferably wherein at least Y3 and/or Y14 and/or Y20 and/or Y26 have been sulfated, or ff) SEQ ID NO:103 (CXCR6_HUMAN_TRD) or SEQ ID NO:106 (CXCR6_HUMAN_N term), preferably wherein at least one or both of Y6 and Y10 has been sulfated, or gg) SEQ ID NO:104 (CXCR6_MACFA_TRD) or SEQ ID NO:107 (CXCR6_MACFA_N term), preferably wherein at least two or all of Y4, Y7 and Y39 have been sulfated, or hh) SEQ ID NO:105 (CXCR6_MOUSE_TRD) or SEQ ID NO:108 (CXCR6_MOUSE_N term), preferably wherein at least one or both of Y11 and Y15 have been sulfated, or ii) SEQ ID NO:157 (CX3CR1_HUMAN_TRD) or SEQ ID NO:160 (CX3CR1_HUMAN_N term), preferably wherein at least Y14 has been sulfated, or jj) SEQ ID NO:158 (CX3CR1_MACFA_TRD), preferably wherein at least Y20 has been sulfated, or kk) SEQ ID NO:161 (CX3CR1_MACFA_N term), preferably wherein at least Y20 or Y22 has been sulfated, or ll) SEQ ID NO:159 (CX3CR1_MOUSE_TRD) or SEQ ID NO:162 (CX3CR1_MOUSE_N term), preferably wherein at least Y15 has been sulfated, or mm) SEQ ID NO:163 (CXCR1_HUMAN_TRD) or SEQ ID NO:166 (CXCR1_HUMAN_N term), preferably wherein at least Y27 has been sulfated, or nn) SEQ ID NO:164 (CXCR1_MACMU_TRD), preferably wherein at least Y14 has been sulfated or oo) SEQ ID NO:167 (CXCR1_MACMU_N term), preferably wherein at least Y14 or Y28 has been sulfated, or pp) SEQ ID NO:165 (CXCR1_MOUSE_TRD) or SEQ ID NO:168 (CXCR1_MOUSE_N term), preferably wherein at least Y6 has been sulfated.

Preferably, the isolated polypeptide according to the current aspect is immobilized, e.g. via a linker. Immobilization may occur without limitation on suitable beads, particles, proteins, or solid supports.

Aspect 2—Conjugate Comprising Isolated Polypeptide

According to a second aspect of the current invention, there is provided a conjugate comprising an isolated sulfated polypeptide according to the first aspect.

For example, the conjugate may comprise a polypeptide according to the first embodiments of the first aspect. For example, the conjugate may comprise a polypeptide according to the second embodiments of the first aspect. For example, the conjugate may comprise a polypeptide according to the third embodiments of the first aspect. For example, the conjugate may comprise a polypeptide according to some embodiments A, B, C of the third embodiments of the first aspect. For example, the conjugate may comprise a polypeptide according to the fourth embodiments of the first aspect. For example, the conjugate may comprise a polypeptide according to some embodiments A, B, C of the fourth embodiments of the first aspect.

For example, the isolated sulfated polypeptide may be attached to a tag or linker for immobilization or retrieval. Suitable tags are selected from the tags known in the art, for example small organic molecules like biotin (which binds strongly and non-covalently to streptavidin), derivatives thereof, or short peptide sequence such as Flag tag, HA tag, Myc tag or His tag (cf. Table 4.1 or example 10.1.2). For some applications, the tag can be a protein, such as human serum albumin (cf. Table 4.1 or example 10.1.2), or a carrier protein, such as KLH, OVA or BSA, or a larger structure such as a bead or magnetic particle. Preferably, the tag can be attached via the C term or at the N term of the TRD or the N terminus of the chemokine receptor but may also be attached via a reactive residue or amino acid side chain, such as a lysine within the TRD. In some embodiments, the tag is attached via a linker, which can be any linker known in the art. Suitable linker include trioxatridecan-succinamic acid (Ttds) linker (cf. Table 4.1), beta-alanine, GABA, AEA, Ava, Ahx, PEG2 spacer, PEG3 spacer, PEG4 spacer, O1Pen, O2Oc or O1Pen-O1.

Aspect 3—Antigen Production Method

Sulfated peptides may be difficult to synthesize e.g. because the sulfate is unstable under acidic conditions (Houben-Weyl, Methods of Organic Chemistry Vol. E 22b, Synthesis of Peptides and Peptidomimetics, 4th Edition, section 6.6.1.2 Synthesis of Sulfated Tyrosine Peptides with Tyrosine 0-Sulfate Synthons, p. 440 ff. in: Felix, Arthur et al.: 2004).

According to a 3rd aspect there is provided a method for production of the isolated sulfated polypeptide according to the first aspect or conjugate according to the second aspect, wherein the method comprises synthesis of the isolated polypeptide and sulfation of the respective tyrosine residues. Synthesis of the isolated polypeptide according to the first aspect and sulfation of the respective tyrosine residues may occur as described in example 5, or may occur according to any other method known in the art. In chapter 6.6.1 "Methods of Organic Chemistry Vol. E 22b, Synthesis of Peptides and Peptidomimetics", Houben-Weyl describe various chemical approaches for the synthesis of sulfated tyrosine peptides. The chapter, and in particular these methods, are incorporated herein by reference in their entirety.

For example, synthesis may be performed using the sequence independent solid phase method previously described by Bunschoten et al. (Bunschoten, Anton, et al. "A general sequence independent solid phase method for the site specific synthesis of multiple sulfated-tyrosine containing peptides." Chemical communications 21 (2009): 2999-3001.), incorporated herein in its entirety. In brief, a peptide is synthesized according to the Fmoc-tBu-strategy, followed by selective deprotection of the tyrosine residues to be sulfated and introduction of a protected sulfate group. Upon completion of the synthesis of the sulfated peptide, it is cleaved from the resin by acidolysis and protection groups are removed with the exception of the sulfate protection group, thereby preventing undesired acid induced removal of the sulfate group(s) during this step. Finally, the sulfate protecting groups can be removed in a slightly acidic reductive step, leaving the sulfate groups untouched.

Chen et al. have reported a short and efficient one-step route to sY-containing peptides, wherein Fmoc-protected fluorosulfated tyrosine (Y(OSO2F)) is incorporated into the peptide of interest through an Fmoc-based solid-phase synthetic strategy (cf. Chen, Wentao, et al. "Synthesis of Sulfotyrosine-Containing Peptides by Incorporating Fluorosulfated Tyrosine Using an Fmoc-Based Solid-Phase Strategy." Angewandte Chemie 128.5 (2016): 1867-1870.), incorporated herein in its entirety. Standard simultaneous peptide-resin cleavage and removal of the acid-labile side-chain protecting groups yield the crude peptides containing fluorosulfated tyrosine. Basic ethylene glycol, serving as solvent and reactant, transforms the fluorosulfated tyrosine peptides into sulfotyrosine peptides in high yield.

Global sulfation of polypeptides is likewise possible, for example using sulfur trioxide-pyridine. According to the current invention, this route can be used, if all tyrosines have to be sulfated or if "crude" mixtures of partially sulfated polypeptides shall be used for further steps. Furthermore, sulfation may occur enzymatically, e.g. in a biotransformation reaction using the natural sulfation enzymes or engineered versions thereof. Preferably, the sulfation of the respective tyrosine may occur chemically or enzymatically. Preferably, the synthesis of the isolated polypeptide occurs using Fmoc-tBu-strategy. According to some embodiments of the 3rd aspect, the method comprises purifying the obtained polypeptides. Purification may occur for example by HPLC, e.g. using a C18 column. According to some embodiments of the 3rd aspect, the method comprises analytical characterization of the polypeptide. Without limitation, analytical characterization may be performed using spectroscopic methods or mass spectrometry.

Aspect 4—Uses of the Antigen/Methods Compr. Use of the Antigen

According to a $4^{th}$ aspect there is provided the use of the isolated sulfated polypeptide according to the first aspect or conjugate according to the second aspect for antibody generation, as antigen or for off-target panning, and/or for characterization of an antibody. For example, the isolated sulfated polypeptide according to the first aspect or conjugate according to the second aspect can be used for the generation of a fully human antibody or a fragment thereof. For example, the isolated sulfated polypeptide according to the first aspect or conjugate according to the second aspect can be used for the generation of a cross reactive antibody.

According to some first embodiments according to the $4^{th}$ aspect, there is provided the use of the isolated sulfated polypeptide according to the first aspect or conjugate according to the second aspect for antibody generation. In particular, the isolated sulfated polypeptide according to the first aspect may be used to facilitate the generation of antibodies specifically recognizing chemokine receptors, as described elsewhere herein.

According to some second embodiments according to the $4^{th}$ aspect, which may be the same as or different from the first embodiments according to the $4^{th}$ aspect, the isolated sulfated polypeptide according to the first aspect or conjugate according to the second aspect is used as antigen, e.g. to select antibodies, antibody fragments or molecules specifically binding to chemokine receptors, cf examples 6 and 8.

According to some third embodiments according to the $4^{th}$ aspect, which may be the same as or different from the first and/or second embodiments according to the $4^{th}$ aspect, the isolated sulfated polypeptide according to the first aspect or conjugate according to the second aspect is used for off-target panning to select antibodies which do not bind a certain seven transmembrane receptor, e.g. a chemokine receptor (off-target receptor), cf examples 6 and 8.

According to some fourth embodiments, the method according to the $4^{th}$ aspect comprises the use of the isolated sulfated polypeptide according to the first aspect or conjugate according to the second aspect for characterization of an antibody. Preferably, the antibody is an antibody according to the current invention. For example, the characterization of the antibody may comprise the use of ELISA, surface plasmon resonance, mass spectrometry, competition assays, staining, IHC, FACS, or various further assays known in the art.

Aspect 5—Antibody Production Method

According to a $5^{th}$ aspect, there is provided a method for obtaining an antibody or binder, the method comprising the use of the isolated sulfated polypeptide according to the first aspect or conjugate according to the second aspect.

According to some first embodiments, the method according to the 5th aspect comprises the use of the isolated sulfated polypeptide according to the first aspect or conjugate according to the second aspect as antigen.

According to some preferred of the first embodiments of the $5^{th}$ aspect, the method comprises the use of at least one further isolated polypeptide or conjugate thereof, wherein the at least one further isolated polypeptide comprises a TRD
  a) of a seven transmembrane receptor different from the first seven transmembrane receptor, or
  b) of the first seven transmembrane receptor derived from a different species, preferably wherein the at least one further isolated polypeptide is an isolated polypeptide according to the first aspect.

According to some embodiments A of the first embodiments of the $5^{th}$ aspect, the method comprises the use of at least one further isolated polypeptide or conjugate, preferably according to the first or second aspect, preferably either as antigen or for off-target selection. For these embodiments, the first isolated sulfated polypeptide comprises a TRD of a first seven transmembrane receptor (e.g. a chemokine receptor) and the further isolated polypeptide or conjugate comprises a TRD of a seven transmembrane receptor different from the first seven transmembrane receptor. Where the further isolated polypeptide or conjugate is used as antigen, the method is a method for the production of antibodies or binders recognizing at least two different seven transmembrane receptors, e.g. two different chemokine receptor family members.

Where the further isolated polypeptide or conjugate is used for off target panning, the method is a method for the production of antibodies or binders recognizing only a specific seven transmembrane receptor, e.g. to avoid off target binding to the further chemokine receptor family members.

According to some embodiments B of the first embodiments of the $5^{th}$ aspect, the method comprises the use of at least one further isolated polypeptide or conjugate, preferably according to the first or second aspect, either as antigen or for off-target selection. For these embodiments, the first isolated polypeptide comprises a TRD of a first seven transmembrane receptor of a first species (e.g. a human chemokine receptor) and the further isolated polypeptide comprises a TRD of the same seven transmembrane receptor derived from a different species (e.g. a cynomolgus chemokine receptor). For example, the first polypeptide may comprise the TRD of a human chemokine receptor, and the second polypeptide may comprise the TRD of a cynomolgus chemokine receptor.

Figures 1, 2A:
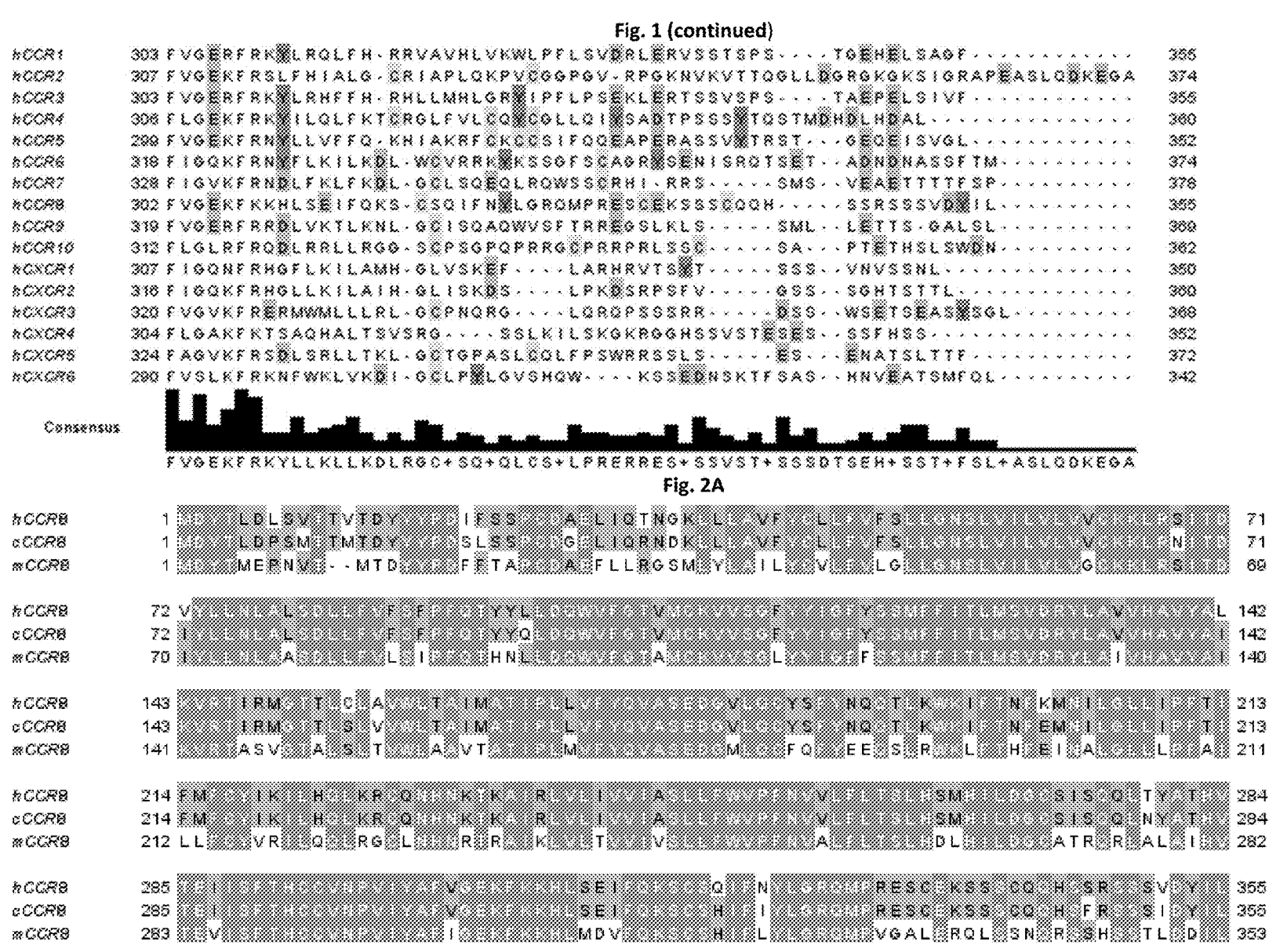

These embodiments B are of particular advantage, because the generation of chemokine receptor antibodies or binders which are cross reactive for both human and a suitable model species is difficult for chemokine receptors, in particular for CCR8. While the overall consensus between the transmembrane domains is comparably high, the extracellular domains of chemokine receptors have a low consensus between the different chemokine receptor family members, and also between the species for a given chemokine receptor (FIG. 1, FIG. 2A). However, according to the current invention it was now found, that small sulfated tyrosine comprising motifs within the TRD are sufficiently conserved for a given chemokine receptor to be used to obtain high numbers of cross-reactive antibodies. Example 6 describes the generation of cross-reactive antibodies for human and cynomolgus, and example 10.1.1 shows excellent affinities in both species for various antibodies according to the current invention. Compared with rodents and mice, cynomolgus is a preferred model system, because mouse models have failed to predict immunological side effects.

The method according to the $5^{th}$ aspect may be any method for antibody generation known in the art. For example, the method may be a conventional immunization method, e.g. wherein the polypeptide according to the first aspect is conjugated to KLH and is administered to a suitable animal for immunization.

For example, after immunization, the splenocytes of the immunized animals can be used for the generation of hybridoma cells, which produce the antibodies of the animals, and in a second step can be screened for antibodies specifically binding to the antigen by methods known in the art like e.g. ELISA as well as binding to an off-target, if applicable. Alternatively, the splenocytes can be directly screened for the production of antibodies binding to the antigen in droplet based microfluidic systems or in cell culture assays. Afterwards only selected splenocytes are directly applied to sequencing to obtain the sequence of the antibody or hybridoma generation. Another method can comprise using the antigen for panning with an antibody library which for example can be a phage display library, e.g. without limitation as described elsewhere herein, or alternatively a mammalian library. After panning of the library on the antigen the enriched antibodies can be screened for specific binding to the antigen by methods known in the art like e.g. ELISA or SPR, as described in more detail herein.

According to some second embodiments of the $5^{th}$ aspect, which may be the same as or different from the first embodiments of the $5^{th}$ aspect, the method for obtaining an antibody according to the $5^{th}$ aspect, is a method comprising the use of a phage display library, a transgenic animal, or any other technique available in the art for the generation of antibodies comprising human CDRs.

In some embodiments A of the second embodiments of the $5^{th}$ aspect, the method comprises the use of a human phage display library, cf. example 6 and example 8. For example, the phage display library can be a fully human antibody phage display library, such as the Biolnvent n-CoDeR Fab lambda library. In some preferred embodiments, the Phage display library is enriched for tyrosine and/or histidine content. In a first step, the phage display library comprising bacteriophages displaying antibodies or antibody fragments on their outside may be combined with the immobilized isolated polypeptide according to the first aspect or conjugate according to the second aspect to allow binding to the isolated polypeptide or conjugate.

In an optional second depletion step, which may occur before or after the first step, the phage display library comprising bacteriophages displaying antibodies or antibody fragments on their outside may be combined with an immobilized isolated polypeptide or conjugate according to the first aspect, being different from the isolated polypeptide of the first step, to deplete off-target binders.

In an optional third step, which may occur before or after the first step, or may occur before or after the second step, the phage display library comprising bacteriophages displaying antibodies or antibody fragments on their outside may be combined with an immobilized isolated polypeptide according to the first aspect or conjugate according to the second aspect being different from the isolated polypeptide of the first step and from the isolated polypeptide of the optional second step, to obtain cross reactive binders. Each of the steps may be repeated multiple times, e.g. one, two, three, four, five, six, seven eight, nine, ten or more times. Binding antibodies or fragments can be retrieved for expansion by infection of suitable bacterial hosts and the DNA can be sequenced as known in the art to obtain the sequence of the seven transmembrane receptor antibody or fragment.

In some embodiments B of the second embodiments of the $5^{th}$ aspect, the method for obtaining an antibody according to the 5th aspect, is a method comprising the use of transgenic animals as described by Lonberg (Lonberg, Nils. "Human antibodies from transgenic animals." Nature biotechnology 23.9 (2005): 1117-1125.), incorporated herein in its entirety. For example, the transgenic animal may be a XenoMouse (Abgenix Inc., Fremont, Calif., e.g. U.S. Pat. No. 5,939,598), the HuMAb Mouse (GenPharm-Medarex, San Jose, Calif.), the RenMab Mouse (Biocytogen), or any other animal known in the art for the generation of fully human antibodies.

In some embodiments C of the second embodiments of the $5^{th}$ aspect, the method for obtaining an antibody according to the 5th aspect, is a method comprising the use of in vitro activated B cells (see, U.S. Pat. Nos. 5,567,610 and 5,229,275, each of which is incorporated herein by reference in its entirety).

According to some third embodiments of the $5^{th}$ aspect there is provided a method for obtaining an antibody or antibody fragment or a binder, which specifically binds to a human and/or cynomolgus and/or murine CC or CXC chemokine receptor, the method comprising a) (synthetically) sulfating a polypeptide comprising a tyrosine rich domain (TRD) and b) selection of an antibody, antibody fragment or binder recognizing the sulfated polypeptide, and c) optionally producing the antibody, antibody fragment or binder.

In some embodiments, the use according to the 4$^{th}$ aspect, or the method according to the 5$^{th}$ aspect is a use/method to obtain an antibody with favorable properties as described elsewhere herein, preferably wherein the antibody
a) comprises human derived CDRs, and/or
b) is a human, rat or murine IgG antibody, preferably a human IgG1 antibody or a murine IgG2a antibody, and/or
c) is cross reactive for two different seven transmembrane receptors, and/or
d) is cross reactive for a human and a cynomolgus seven transmembrane receptor, and/or e) is characterized by a HCDR3 region comprising between 10 and 34% of tyrosine and/or between 2 and 20% of histidine, preferably between 7 and 20% of histidine and/or
f) does not modulate G protein independent signaling of the chemokine receptor, and/or
g) is a non-internalizing antibody or is characterized by an internalization into a cell with endogenous target expression which is lower than the 1.5, 2, 3, 4, 5, 6, 7, or 10-fold of the internalization of the isotype control.

The method according to the current aspect can be used to obtain high numbers of antibodies binding chemokine receptors. Interestingly, a comparably high number of these antibodies were characterized by properties differentiating them from the known antibodies obtained with conventional methods as described elsewhere herein.

Aspect 6—Antibody Defined by Antigen

According to the current invention, there is provided an isolated antibody or antigen-binding fragment thereof or a binder obtained with a method or use according to a previous aspect.

As will be appreciated by skilled artisans, antibodies and/or binding fragments are "modular" in nature. Throughout the disclosure, various specific aspects and embodiments of the various "modules" composing the antibodies and/or binding fragments are described. As specific non-limiting examples, various specific embodiments of VH CDRs, VH chains, VL CDRs and VL chains or functional features are described. It is intended that all of the specific embodiments may be combined with each other as though each specific combination were explicitly described individually. As specific non-limiting examples, various specific functional embodiments are described. It is intended that all of the specific embodiments may be combined with each other as though each specific combination were explicitly described individually.

According to a 6$^{th}$ aspect, there is provided an isolated antibody or antigen-binding fragment thereof, (specifically) binding to a first isolated sulfated polypeptide which comprises the tyrosine rich domain (TRD) of a seven transmembrane receptor, wherein at least 25%, at least 50% or at least 75% of the tyrosine residues of the TRD are sulfated. Preferably, the first isolated sulfated polypeptide furthermore comprises the LID domain of the seven transmembrane receptor. Preferably, the cysteine between the TRD and the LID domain has been removed or has been exchanged into a different amino acid. Preferably, the first isolated sulfated polypeptide comprises the N terminus of a seven transmembrane receptor including its tyrosine rich domain (TRD) and optionally including its LID domain, and even more preferably, at least 25%, at least 50% or at least 75% of the tyrosine residues of the TRD are sulfated.

In preferred embodiments, the isolated antibody or antigen-binding fragment thereof binds its target(s) with a KD value of <5E-8 M, <4E-8 M, <3E-8 M, <2E-8 M, <1E-8 M, <9E-9 M, <8E-9 M, <7E-9 M, <6E-9 M, <5E-9 M, <4E-9 M, <3E-9 M, <2.5E-9 M, <2E-9 M, <1.5E-9 M, <1E-9 M, <9E-10 M, <8E-10 M, <7E-10 M, <6E-10 M, <5E-10 M, <4E-10 M, <3E-10 M, <2.5E-10 M, <2E-10 M, <1.5E-10 M, <1E-10 M, or <9E-11 M. For example, the inventive antibody may bind its target(s) with a KD value between <8E-9 M and >4E-10 M. Where the isolated antibody or antigen-binding fragment thereof binds more than one target, most preferably it binds its' targets with an affinity in the same order of magnitude.

According to some preferred embodiments, the isolated antibody or antigen-binding fragment thereof
a) comprises human derived CDRs, and/or
b) is cross reactive for human and cynomolgus, and/or
c) is characterized by a HCDR3 region comprising between 10 and 34% of tyrosine and/or between 7 and 20% of histidine, and/or
d) does not modulate G protein independent signaling of the seven transmembrane receptor, and/or
e) is a non-internalizing antibody or is characterized by an internalization into a cell with endogenous target expression which is lower than the 1.5, 2, 3, 4, 5, 6, 7, or 10-fold of the internalization of the isotype control, and/or
f) induces ADCC and/or ADCP and/or
g) is a human, rat or murine IgG antibody, preferably a human IgG1 antibody or a murine IgG2a antibody, and/or
h) is an scFv, Fab, Fab' or a F(ab')2 fragment.

According to some first embodiments of the 6$^{th}$ aspect, the seven transmembrane receptor is a chemokine receptor. In some of these first embodiments, the seven transmembrane receptor is a CC chemokine receptor or a CXC chemokine receptor. In some of these first embodiments, the seven transmembrane receptor is a CC chemokine receptor, such as CCR1, CCR2, CCR3, CCR4, CCR5, CCR6, CCR7, CCR8, CCR9 or CCR10. In some preferred of these first embodiments, the seven transmembrane receptor is CCR8 or CCR4. In some most preferred of these first embodiments, the seven transmembrane receptor is CCR8. In some of the first embodiments, the seven transmembrane receptor is a CXC chemokine receptor, such as CXCR1, CXCR2, CXCR3, CXCR4, CXCR5, or CXCR6. In some of the first embodiments, the seven transmembrane receptor is CX3CR1 or CXCR1.

According to some second embodiments of the 6$^{th}$ aspect, which may or may not be the same as the first embodiments of the 6$^{th}$ aspect, the seven transmembrane receptor may be from any species expressing chemokine receptors characterized by a TRD, e.g. human, monkey, *Macaca fascicularis* (cynomolgus monkey), *Macaca mulatta* (Rhesus macaque), rodent, mouse, rat, horse, bovine, pig, dog, cat and camel. In some of these second embodiments of the 6$^{th}$ aspect, the seven transmembrane receptor is murine. In some most preferred of these second embodiments of the sixth aspect, the seven transmembrane receptor is human. In some of these second embodiments of the sixth aspect, the seven transmembrane receptor is cynomolgus. In some preferred of these embodiments, the seven transmembrane receptor is human, cynomolgus or mouse. In some of these preferred second embodiments of the sixth aspect, the seven transmembrane receptor is human or cynomolgus.

In some preferred embodiments, the seven transmembrane receptor is a human, cynomolgus or mouse seven transmembrane receptor and the seven transmembrane receptor is
a) a CC chemokine receptor, preferably CCR1, CCR2, CCR3, CCR4, CCR5, CCR6, CCR7, CCR8, CCR9 or CCR10, b) a CXC chemokine receptor, preferably CXCR1, CXCR2, CXCR3, CXCR4, CXCR5, or CXCR6, or
c) CX3CR1 or CXCR1.

According to some third embodiments of the $6^{th}$ aspect, which may be or may not be the same as the first and/or second embodiments according to the $6^{th}$ aspect, the (first) isolated sulfated polypeptide comprises or consists of a sequence according to
a) SEQ ID NO:1 (CCR1_HUMAN_TRD), SEQ ID NO:4 (CCR1_HUMAN_N term), SEQ ID NO:2 (CCR1_MACFA_TRD), SEQ ID NO:5 (CCR1_MACFA_N term), SEQ ID NO:3 (CCR1_MOUSE_TRD) or SEQ ID NO:6 (CCR1_MOUSE_N term), preferably wherein at least Y10 and/or Y18 have been sulfated, or
b) SEQ ID NO:7 (CCR2_HUMAN_TRD), SEQ ID NO:10 (CCR2_HUMAN_N term), SEQ ID NO:8 (CCR2_MACMU_TRD) or SEQ ID NO:11 (CCR2_MACMU_N term), preferably wherein at least Y26 has been sulfated, or
c) SEQ ID NO:9 (CCR2_MOUSE_TRD) or SEQ ID NO:12 (CCR2_MOUSE_N term), preferably wherein at least Y37 and/or Y39 has been sulfated, or
d) SEQ ID NO:13 (CCR3_HUMAN_TRD) or SEQ ID NO:16 (CCR3_HUMAN_N term), preferably wherein Y16 and/or Y17 have been sulfated, or
e) SEQ ID NO:14 (CCR3_MACFA_TRD) or SEQ ID NO:17 (CCR3_MACFA_N term), preferably wherein Y16 has been sulfated, or
f) SEQ ID NO:15 (CCR3_MOUSE_TRD) or SEQ ID NO:18 (CCR3_MOUSE_N term), preferably wherein Y20 and/or Y22 has been sulfated, or
g) SEQ ID NO:19 (CCR4_HUMAN_TRD), SEQ ID NO:22 (CCR4_HUMAN_N term), SEQ ID NO:20 (CCR4_MACFA_TRD), SEQ ID NO:23 (CCR4_MACFA_N term), SEQ ID NO:21 (CCR4_MOUSE_TRD) or SEQ ID NO:24 (CCR4_MOUSE_N term), preferably wherein at least Y22 has been sulfated and preferably furthermore Y16, Y19 and/or Y20 have been sulfated, or
h) SEQ ID NO:25 (CCR5_HUMAN_TRD), SEQ ID NO:28 (CCR5_HUMAN_N term), SEQ ID NO:26 (CCR5_MACMU_TRD) or SEQ ID NO:29 (CCR5_MACMU_N term), preferably wherein two, three or all of Y3, Y10, Y14 and Y15 have been sulfated, or
i) SEQ ID NO:27 (CCR5_MOUSE_TRD) or SEQ ID NO:30 (CCR5_MOUSE_N term), preferably wherein two or three of Y10, Y12 and Y16 have been sulfated, or
j) SEQ ID NO:31 (CCR6_HUMAN_TRD) or SEQ ID NO:34 (CCR6_HUMAN_N term), preferably wherein at least two or three of Y18, Y26 and Y27 have been sulfated, or
k) SEQ ID NO:32 (CCR6_MACFA_TRD) or SEQ ID NO:35 (CCR6_MACFA_N term), preferably wherein at least two or three of Y23, Y31 and Y32 have been sulfated, or
l) SEQ ID NO:33 (CCR6_MOUSE_TRD) or SEQ ID NO:36 (CCR6_MOUSE_N term), preferably wherein at least two or three of Y13, Y18 and Y19 have been sulfated, or
m) SEQ ID NO:37 (CCR7_HUMAN_TRD), SEQ ID NO:40 (CCR7_HUMAN_N term), SEQ ID NO:38 (CCR7_MACFA_TRD) or SEQ ID NO:41 (CCR7_MACFA_N term), preferably wherein one or both of Y8 and Y17 have been sulfated, or
n) SEQ ID NO:39 (CCR7_MOUSE_TRD) or SEQ ID NO:42 (CCR7_MOUSE_N term), preferably wherein one or both of Y8 and Y17 and optionally Y20 have been sulfated have been sulfated, or
o) SEQ ID NO:43 (CCR8_HUMAN_TRD), SEQ ID NO:44 (CCR8_MACFA_TRD), SEQ ID NO:46 (CCR8_HUMAN_N term with C=X or S), or SEQ ID NO:47 (CCR8_MACFA_N term with C=X or S), preferably wherein at least two or all of Y3, Y15 and Y17 have been sulfated, or
p) SEQ ID NO:45 (CCR8_MOUSE_TRD) or SEQ ID NO:48 (CCR8_MOUSE_N term with C=X or S), preferably wherein at least two or all of Y3, Y14 and Y15 have been sulfated, or
q) SEQ ID NO:61 (CCR9_HUMAN_TRD), SEQ ID NO:64 (CCR9_HUMAN_N term), SEQ ID NO:62 (CCR9_MACFA_TRD) or SEQ ID NO:65 (CCR9_MACFA_N term), preferably wherein at least Y28, and preferably also Y17 and/or Y37 has been sulfated, or
r) SEQ ID NO:63 (CCR9_MOUSE_TRD) or SEQ ID NO:66 (CCR9_MOUSE_N term), preferably wherein at least Y28 has been sulfated, and preferably also Y19 has been sulfated, or
s) SEQ ID NO:67 (CCR10_HUMAN_TRD), SEQ ID NO:70 (CCR10_HUMAN_N term), SEQ ID NO:68 (CCR10_MACFA_TRD) or SEQ ID NO:71 (CCR10_MACFA_N term), preferably wherein at least one or both of Y14 and Y22 has been sulfated, or
t) SEQ ID NO:69 (CCR10_MOUSE_TRD) or SEQ ID NO:72 (CCR10_MOUSE_N term), preferably wherein at least one, two or all of Y14, Y17 and Y22 has been sulfated, or
u) SEQ ID NO:73 (CXCR1_HUMAN_TRD) or SEQ ID NO:76 (CXCR1_HUMAN_N term), preferably wherein Y27 has been sulfated, or
v) SEQ ID NO:74 (CXCR1_MACFA_TRD) or SEQ ID NO:77 (CXCR1_MACFA_N term), preferably wherein at least one of Y14 and Y28 has been sulfated, or
w) SEQ ID NO:75 (CXCR1_MOUSE_TRD) or SEQ ID NO:78 (CXCR1_MOUSE_N term), preferably wherein at least Y6 has been sulfated, or
x) SEQ ID NO:79 (CXCR2_HUMAN_TRD) or SEQ ID NO:82 (CXCR2_HUMAN_N term), preferably wherein Y23 and/or Y25 have been sulfated, or
y) SEQ ID NO:80 (CXCR2_MACFA_TRD) or SEQ ID NO:83 (CXCR2_MACFA_N term), preferably wherein Y20 and/or Y22 have been sulfated, or
z) SEQ ID NO:81 (CXCR2_MOUSE_TRD) or SEQ ID NO:84 (CXCR2_MOUSE_N term), preferably wherein Y24 has been sulfated, or
aa) SEQ ID NO:85 (CXCR3_HUMAN_TRD), SEQ ID NO:88 (CXCR3_HUMAN_N term), SEQ ID NO:86 (CXCR3_MACFA_TRD), SEQ ID NO:89 (CXCR3_MACFA_N term), SEQ ID NO:87 (CXCR3_MOUSE_TRD) or SEQ ID NO:90 (CXCR3_MOUSE_N term), preferably wherein at least one or both of Y27 and Y29 have been sulfated, or
bb) SEQ ID NO:91 (CXCR4_HUMAN_TRD), SEQ ID NO:94 (CXCR4_HUMAN_N term), SEQ ID NO:92 (CXCR4_MACFA_TRD) or SEQ ID NO:95 (CXCR4_MACFA_N term), preferably wherein at least Y12 and/or Y21 have been sulfated, or
cc) SEQ ID NO:93 (CXCR4_MOUSE_TRD) or SEQ ID NO:96 (CXCR4_MOUSE_N term), preferably wherein at least Y23 and/or Y14 have been sulfated, or
dd) SEQ ID NO:97 (CXCR5_HUMAN_TRD), SEQ ID NO:100 (CXCR5_HUMAN_N term), SEQ ID NO:98 (CXCR5_MACFA_TRD) or SEQ ID NO:101

(CXCR5_MACFA_N term), preferably wherein at least one of Y3 and Y27 have been sulfated, or
ee) SEQ ID NO:99 (CXCR5_MOUSE_TRD) or SEQ ID NO:102 (CXCR5_MOUSE_N term), preferably wherein at least Y3 and/or Y14 and/or Y20 and/or Y26 have been sulfated, or
ff) SEQ ID NO:103 (CXCR6_HUMAN_TRD) or SEQ ID NO:106 (CXCR6_HUMAN_N term), preferably wherein at least one or both of Y6 and Y10 has been sulfated, or
gg) SEQ ID NO:104 (CXCR6_MACFA_TRD) or SEQ ID NO:107 (CXCR6_MACFA_N term), preferably wherein at least two or all of Y4, Y7 and Y39 have been sulfated, or
hh) SEQ ID NO:105 (CXCR6_MOUSE_TRD) or SEQ ID NO:108 (CXCR6_MOUSE_N term), preferably wherein at least one or both of Y11 and Y15 have been sulfated, or
ii) SEQ ID NO:157 (CX3CR1_HUMAN_TRD) or SEQ ID NO:160 (CX3CR1_HUMAN_N term), preferably wherein at least Y14 has been sulfated, or
jj) SEQ ID NO:158 (CX3CR1_MACFA_TRD), preferably wherein at least Y20 has been sulfated, or
kk) SEQ ID NO:161 (CX3CR1_MACFA_N term), preferably wherein at least Y20 or Y22 has been sulfated, or
ll) SEQ ID NO:159 (CX3CR1_MOUSE_TRD) or SEQ ID NO:162 (CX3CR1_MOUSE_N term), preferably wherein at least Y15 has been sulfated, or
mm) SEQ ID NO:163 (CXCR1_HUMAN_TRD) or SEQ ID NO:166 (CXCR1_HUMAN_N term), preferably wherein at least Y27 has been sulfated, or
nn) SEQ ID NO:164 (CXCR1_MACMU_TRD), preferably wherein at least Y14 has been sulfated or
oo) SEQ ID NO:167 (CXCR1_MACMU_N term), preferably wherein at least Y14 or Y28 has been sulfated, or
pp) SEQ ID NO:165 (CXCR1_MOUSE_TRD) or SEQ ID NO:168 (CXCR1_MOUSE_N term), preferably wherein at least Y6 has been sulfated.

According to some embodiments A of the third embodiments of the 6$^{th}$ aspect, the (first) isolated sulfated polypeptide comprises or consists of a sequence according to
a. SEQ ID NO:1 (CCR1_HUMAN_TRD), preferably wherein at least Y10 and/or Y18 have been sulfated, or
b. SEQ ID NO:7 (CCR2_HUMAN_TRD), preferably wherein at least Y26 has been sulfated, or
c. SEQ ID NO:13 (CCR3_HUMAN_TRD), preferably wherein Y16 and/or Y17 have been sulfated, or
d. SEQ ID NO:19 (CCR4_HUMAN_TRD), preferably wherein at least Y22 has been sulfated and preferably furthermore Y16, Y19 and/or Y20 have been sulfated, or
e. SEQ ID NO:25 (CCR5_HUMAN_TRD), preferably wherein two, three or all of Y3, Y10, Y14 and Y15 have been sulfated, or
f. SEQ ID NO:31 (CCR6_HUMAN_TRD), preferably wherein at least two or three of Y18, Y26 and Y27 have been sulfated, or
g. SEQ ID NO:37 (CCR7_HUMAN_TRD), preferably wherein one or both of Y8 and Y17 have been sulfated, or
h. SEQ ID NO:43 (CCR8_HUMAN_TRD), preferably wherein at least two or all of Y3, Y15 and Y17 have been sulfated, or
i. SEQ ID NO:61 (CCR9_HUMAN_TRD), preferably also Y17 and/or Y37 has been sulfated, or
j. SEQ ID NO:67 (CCR10_HUMAN_TRD), preferably wherein at least one or both of Y14 and Y22 has been sulfated, or
k. SEQ ID NO:73 (CXCR1_HUMAN_TRD), preferably wherein Y27 has been sulfated, or
l. SEQ ID NO:79 (CXCR2_HUMAN_TRD), preferably wherein Y23 and/or Y25 have been sulfated, or
m. SEQ ID NO:85 (CXCR3_HUMAN_TRD), preferably wherein at least one or both of Y27 and Y29 have been sulfated, or
n. SEQ ID NO:91 (CXCR4_HUMAN_TRD), preferably wherein at least Y12 and/or Y21 have been sulfated, or
o. SEQ ID NO:97 (CXCR5_HUMAN_TRD), preferably wherein at least one of Y3 and Y27 have been sulfated, or
p. SEQ ID NO:103 (CXCR6_HUMAN_TRD), preferably wherein at least one or both of Y6 and Y10 has been sulfated, or
q. SEQ ID NO:157 (CX3CR1_HUMAN_TRD), preferably wherein at least Y14 has been sulfated, or
r. SEQ ID NO:163 (CXCR1_HUMAN_TRD), preferably wherein at least Y27 has been sulfated.

According to some embodiments B of the third embodiments of the aspect, the (first) isolated sulfated polypeptide comprises or consists of a sequence according to
a) SEQ ID NO:3 (CCR1_MOUSE_TRD), preferably wherein at least Y10 and/or Y18 have been sulfated, or
b) SEQ ID NO:9 (CCR2_MOUSE_TRD), preferably wherein at least Y37 and/or Y39 has been sulfated, or
c) SEQ ID NO:15 (CCR3_MOUSE_TRD), preferably wherein Y20 and/or Y22 has been sulfated, or
d) SEQ ID NO:21 (CCR4_MOUSE_TRD), preferably wherein at least Y22 has been sulfated and preferably furthermore Y16, Y19 and/or Y20 have been sulfated, or
e) SEQ ID NO:27 (CCR5_MOUSE_TRD), preferably wherein two or three of Y10, Y12 and Y16 have been sulfated, or
f) SEQ ID NO:33 (CCR6_MOUSE_TRD), preferably wherein at least two or three of Y13, Y18 and Y19 have been sulfated,
g) SEQ ID NO:39 (CCR7_MOUSE_TRD), preferably wherein one or both of Y8 and Y17 and optionally Y20 have been sulfated have been sulfated, or
h) SEQ ID NO:45 (CCR8_MOUSE_TRD), preferably wherein at least two or all of Y3, Y14 and Y15 have been sulfated, or
i) SEQ ID NO:63 (CCR9_MOUSE_TRD), preferably wherein at least Y28 has been sulfated, and preferably also Y19 has been sulfated, or
j) SEQ ID NO:69 (CCR10_MOUSE_TRD), preferably wherein at least one, two or all of Y14, Y17 and Y22 has been sulfated, or
k) SEQ ID NO:75 (CXCR1_MOUSE_TRD), preferably wherein at least Y6 has been sulfated, or
l) SEQ ID NO:81 (CXCR2_MOUSE_TRD), preferably wherein Y24 has been sulfated, or
m) SEQ ID NO:87 (CXCR3_MOUSE_TRD), preferably wherein at least one or both of Y27 and Y29 have been sulfated, or
n) SEQ ID NO:93 (CXCR4_MOUSE_TRD), preferably wherein at least Y23 and/or Y14 have been sulfated, or
o) SEQ ID NO:99 (CXCR5_MOUSE_TRD), preferably wherein at least Y3 and/or Y14 and/or Y20 and/or Y26 have been sulfated, or
p) SEQ ID NO:105 (CXCR6_MOUSE_TRD), preferably wherein at least one or both of Y11 and Y15 have been sulfated, or
q) SEQ ID NO:159 (CX3CR1_MOUSE_TRD), preferably wherein at least Y15 has been sulfated, or
r) SEQ ID NO:165 (CXCR1_MOUSE_TRD), preferably wherein at least Y6 has been sulfated.

According to some embodiments C of the third embodiments of the 6$^{th}$ aspect, the (first) isolated sulfated polypeptide comprises or consists of a sequence according to
a) SEQ ID NO:2 (CCR1_MACFA_TRD), preferably wherein at least Y10 and/or Y18 have been sulfated, or
b) SEQ ID NO:8 (CCR2_MACMU_TRD), preferably wherein at least Y26 has been sulfated, or
c) SEQ ID NO:14 (CCR3_MACFA_TRD), preferably wherein Y16 has been sulfated, or
d) SEQ ID NO:20 (CCR4MACFA_TRD), preferably wherein at least Y22 has been sulfated and preferably furthermore Y16, Y19 and/or Y20 have been sulfated, or
e) SEQ ID NO:26 (CCR5_MACMU_TRD), preferably wherein two, three or all of Y3, Y10, Y14 and Y15 have been sulfated, or
f) SEQ ID NO:32 (CCR6_MACFA_TRD), preferably wherein at least two or three of Y23, Y31 and Y32 have been sulfated, or
g) SEQ ID NO:38 (CCR7_MACFA_TRD), preferably wherein one or both of Y8 and Y17 have been sulfated, or
h) SEQ ID NO:44 (CCR8_MACFA_TRD), preferably wherein at least two or all of Y3, Y15 and Y17 have been sulfated, or
i) SEQ ID NO:62 (CCR9_MACFA_TRD), preferably wherein at least Y28, and preferably also Y17 and/or Y37 has been sulfated, or
j) SEQ ID NO:68 (CCR10_MACFA_TRD), preferably wherein at least one or both of Y14 and Y22 has been sulfated, or
k) SEQ ID NO:74 (CXCR1_MACFA_TRD), preferably wherein at least one of Y14 and Y28 has been sulfated, or
l) SEQ ID NO:80 (CXCR2_MACFA_TRD), preferably wherein Y20 and/or Y22 have been sulfated, or
m) SEQ ID NO:86 (CXCR3_MACFA_TRD), preferably wherein at least one or both of Y27 and Y29 have been sulfated, or
n) SEQ ID NO:92 (CXCR4_MACFA_TRD), preferably wherein at least Y12 and/or Y21 have been sulfated, or
o) SEQ ID NO:98 (CXCR5_MACFA_TRD), preferably wherein at least one of Y3 and Y27 have been sulfated, or
p) SEQ ID NO:104 (CXCR6_MACFA_TRD), preferably wherein at least two or all of Y4, Y7 and Y39 have been sulfated, or
q) SEQ ID NO:158 (CX3CR1_MACFA_TRD), preferably wherein at least Y20 has been sulfated, or
r) SEQ ID NO:164 (CXCR1_MACMU_TRD), preferably wherein at least Y14 has been sulfated.

According to some fourth embodiments of the 6$^{th}$ aspect, which may or may not be the same as the first, second and/or third embodiments of the 6$^{th}$ aspect, the first isolated sulfated polypeptide comprises the N terminus of a seven transmembrane receptor including tyrosine rich domain (TRD) and preferably LID domain, and at least 25%, at least 50% or at least 75% of the tyrosine residues of the TRD are sulfated, preferably wherein at least one/the cysteine between the TRD and the LID domain has been removed or has been exchanged into a different amino acid.

According to some embodiments A of the fourth embodiments of the 6$^{th}$ aspect, the (first) isolated sulfated polypeptide comprises or consists of a sequence according to
a) SEQ ID NO:4 (CCR1_HUMAN_N term), preferably wherein at least Y10 and/or Y18 have been sulfated,
b) SEQ ID NO:10 (CCR2_HUMAN_N term), preferably wherein at least Y26 has been sulfated,
c) SEQ ID NO:16 (CCR3_HUMAN_N term), preferably wherein Y16 and/or Y17 have been sulfated,
d) SEQ ID NO:22 (CCR4_HUMAN_N term), preferably wherein at least Y22 has been sulfated and preferably furthermore Y16, Y19 and/or Y20 have been sulfated,
e) SEQ ID NO:28 (CCR5_HUMAN_N term), preferably wherein two, three or all of Y3, Y10, Y14 and Y15 have been sulfated,
f) SEQ ID NO:34 (CCR6_HUMAN_N term), preferably wherein at least two or three of Y18, Y26 and Y27 have been sulfated,
g) SEQ ID NO:40 (CCR7_HUMAN_N term), preferably wherein one or both of Y8 and Y17 have been sulfated,
h) SEQ ID NO:46 (CCR8_HUMAN_N term with C=X or S), preferably wherein at least two or all of Y3, Y15 and Y17 have been sulfated,
i) SEQ ID NO:64 (CCR9_HUMAN_N term), preferably wherein at least Y28, and preferably also Y17 and/or Y37 have been sulfated,
j) SEQ ID NO:70 (CCR10_HUMAN_N term), preferably wherein at least one or both of Y14 and Y22 have been sulfated,
k) SEQ ID NO:76 (CXCR1_HUMAN_N term), preferably wherein Y27 has been sulfated,
l) SEQ ID NO:82 (CXCR2_HUMAN_N term), preferably wherein Y23 and/or Y25 have been sulfated,
m) SEQ ID NO:88 (CXCR3_HUMAN_N term), preferably wherein at least one or both of Y27 and Y29 have been sulfated,
n) SEQ ID NO:94 (CXCR4_HUMAN_N term), preferably wherein at least Y12 and/or Y21 have been sulfated,
o) SEQ ID NO:100 (CXCR5_HUMAN_N term), preferably wherein at least one of Y3 and Y27 have been sulfated, or
p) SEQ ID NO:106 (CXCR6_HUMAN_N term), preferably wherein at least one or both of Y6 and Y10 have been sulfated,
q) SEQ ID NO:160 (CX3CR1_HUMAN_N term), preferably wherein at least Y14 has been sulfated, or
r) SEQ ID NO:166 (CXCR1_HUMAN_N term), preferably wherein at least Y27 has been sulfated.

According to some embodiments B of the fourth embodiments of the 6$^{th}$ aspect, the (first) isolated sulfated polypeptide comprises or consists of a sequence according to
a) SEQ ID NO:6 (CCR1_MOUSE_N term), preferably wherein at least Y10 and/or Y18 have been sulfated, or
b) SEQ ID NO:12 (CCR2_MOUSE_N term), preferably wherein at least Y37 and/or Y39 has been sulfated, or
c) SEQ ID NO:18 (CCR3_MOUSE_N term), preferably wherein Y20 and/or Y22 has been sulfated, or
d) SEQ ID NO:24 (CCR4_MOUSE_N term), preferably wherein at least Y22 has been sulfated and preferably furthermore Y16, Y19 and/or Y20 have been sulfated, or
e) SEQ ID NO:30 (CCR5_MOUSE_N term), preferably wherein two or three of Y10, Y12 and Y16 have been sulfated, or
f) SEQ ID NO:36 (CCR6_MOUSE_N term), preferably wherein at least two or three of Y13, Y18 and Y19 have been sulfated, or
g) SEQ ID NO:42 (CCR7_MOUSE_N term), preferably wherein one or both of Y8 and Y17 and optionally Y20 have been sulfated have been sulfated, or
h) SEQ ID NO:48 (CCR8_MOUSE_N term with C=X or S), preferably wherein at least two or all of Y3, Y14 and Y15 have been sulfated, or
i) SEQ ID NO:66 (CCR9_MOUSE_N term), preferably wherein at least Y28 has been sulfated, and preferably also Y19 has been sulfated, or j) SEQ ID NO:72 (CCR10_MOUSE_N term), preferably wherein at least one, two or all of Y14, Y17 and Y22 has been sulfated, or
k) SEQ ID NO:78 (CXCR1_MOUSE_N term), preferably wherein at least Y6 has been sulfated, or
l) SEQ ID NO:84 (CXCR2_MOUSE_N term), preferably wherein Y24 has been sulfated, or
m) SEQ ID NO:90 (CXCR3_MOUSE_N term), preferably wherein at least one or both of Y27 and Y29 have been sulfated, or
n) SEQ ID NO:96 (CXCR4_MOUSE_N term), preferably wherein at least Y13 and/or Y14 have been sulfated, or
o) SEQ ID NO:102 (CXCR5_MOUSE_N term), preferably wherein at least Y3 and/or Y14 and/or Y20 and/or Y26 have been sulfated, or
p) SEQ ID NO:108 (CXCR6_MOUSE_N term), preferably wherein at least one or both of Y11 and Y15 have been sulfated, or
q) SEQ ID NO:162 (CX3CR1_MOUSE_N term), preferably wherein at least Y15 has been sulfated, or
r) SEQ ID NO:168 (CXCR1_MOUSE_N term), preferably wherein at least Y6 has been sulfated.

According to some embodiments C of the fourth embodiments of the 6$^{th}$ aspect, the (first) isolated sulfated polypeptide comprises or consists of a sequence according to
a) SEQ ID NO:5 (CCR1_MACFA_N term), preferably wherein at least Y10 and/or Y18 have been sulfated, or
b) SEQ ID NO:11 (CCR2_MACMU_N term), preferably wherein at least Y26 has been sulfated, or
c) SEQ ID NO:17 (CCR3_MACFA_N term), preferably wherein Y16 has been sulfated, or
d) SEQ ID NO:23 (CCR4_MACFA_N term), preferably wherein at least Y22 has been sulfated and preferably furthermore Y16, Y19 and/or Y20 have been sulfated, or
e) SEQ ID NO:29 (CCR5_MACMU_N term), preferably wherein two, three or all of Y3, Y10, Y14 and Y15 have been sulfated, or
f) SEQ ID NO:35 (CCR6_MACFA_N term), preferably wherein at least two or three of Y23, Y31 and Y32 have been sulfated, or
g) SEQ ID NO:41 (CCR7_MACFA_N term), preferably wherein one or both of Y8 and Y17 have been sulfated, or
h) SEQ ID NO:47 (CCR8_MACFA_N term with C=X or S), preferably wherein at least two or all of Y3, Y15 and Y17 have been sulfated, or
i) SEQ ID NO:65 (CCR9_MACFA_N term), preferably wherein at least Y28, and preferably also Y17 and/or Y37 has been sulfated, or
j) SEQ ID NO:71 (CCR10_MACFA_N term), preferably wherein at least one or both of Y14 and Y22 has been sulfated, or
k) SEQ ID NO:77 (CXCR1_MACFA_N term), preferably wherein at least one of Y14 and Y28 has been sulfated, or
l) SEQ ID NO:83 (CXCR2_MACFA_N term), preferably wherein Y20 and/or Y22 have been sulfated, or
m) SEQ ID NO:89 (CXCR3_MACFA_N term), preferably wherein at least one or both of Y27 and Y29 have been sulfated, or
n) SEQ ID NO:95 (CXCR4_MACFA_N term), preferably wherein at least Y12 and/or Y21 have been sulfated, or
o) SEQ ID NO:101 (CXCR5_MACFA_N term), preferably wherein at least one of Y3 and Y27 have been sulfated, or
p) SEQ ID NO:107 (CXCR6_MACFA_N term), preferably wherein at least two or all of Y4, Y7 and Y39 have been sulfated, or
q) SEQ ID NO:161 (CX3CR1_MACFA_N term), preferably wherein at least Y20 or Y22 has been sulfated, or
r) SEQ ID NO:167 (CXCR1_MACMU_N term), preferably wherein at least Y14 or Y28 has been sulfated.

According to some fifth embodiments of the aspect, which may be or may not be the same as the first, second, third and/or fourth embodiments according to the 6$^{th}$ aspect, the isolated antibody or antigen-binding fragment thereof, (specifically) binds to a second isolated sulfated polypeptide which comprises the tyrosine rich domain (TRD) of a seven transmembrane receptor.

Preferably the seven transmembrane receptor of the TRD comprised by the second isolated sulfated polypeptide
a) is different from the seven transmembrane receptor of the TRD comprised by the first isolated sulfated polypeptide, or is
b) the corresponding seven transmembrane receptor of the TRD comprised by the first isolated sulfated polypeptide but from a different species.

According to some preferred embodiments, the second isolated sulfated polypeptide which comprises the tyrosine rich domain (TRD) of a seven transmembrane receptor is different from the first isolated sulfated polypeptide which comprises the tyrosine rich domain (TRD) of a seven transmembrane receptor and is an isolated polypeptide with a sequence according to any of embodiments A, B, or C according to the third and/or fourth embodiments of the 6$^{th}$ aspect. For example, the first isolated sulfated polypeptide may comprise the TRD of a seven transmembrane receptor of a first species and the second isolated sulfated polypeptide may comprise the TRD of a seven transmembrane receptor of a second species, preferably wherein the species are human and cynomolgus, or human and mouse, or human and rat.

According to some embodiments A of the fifth embodiments of the 6$^{th}$ aspect, the antibody or fragment specifically binds to
a) a first isolated sulfated polypeptide comprising SEQ ID NO:1 (CCR1_HUMAN_TRD), preferably wherein at least Y10 and/or Y18 have been sulfated, and a second isolated sulfated polypeptide comprising SEQ ID NO:2 (CCR1_MACFA_TRD), preferably wherein at least Y10 and/or Y18 have been sulfated, or
b) a first isolated sulfated polypeptide comprising SEQ ID NO:7 (CCR2_HUMAN_TRD), preferably wherein at least Y26 has been sulfated, and a second isolated sulfated polypeptide comprising SEQ ID NO:8 (CCR2_MACMU_TRD), preferably wherein at least Y26 has been sulfated, or
c) a first isolated sulfated polypeptide comprising SEQ ID NO:13 (CCR3_HUMAN_TRD), preferably wherein Y16 and/or Y17 have been sulfated, and a second isolated sulfated polypeptide comprising SEQ ID NO:14 (CCR3_MACFA_TRD), preferably wherein Y16 has been sulfated, or
d) a first isolated sulfated polypeptide comprising SEQ ID NO:19 (CCR4_HUMAN_TRD), preferably wherein at least Y22 has been sulfated and preferably furthermore Y16, Y19 and/or Y20 have been sulfated, and a second isolated sulfated polypeptide comprising SEQ ID NO:20 (CCR4_MACFA_TRD), preferably wherein at least Y22 has been sulfated and preferably furthermore Y16, Y19 and/or Y20 have been sulfated, or
e) a first isolated sulfated polypeptide comprising SEQ ID NO:25 (CCR5_HUMAN_TRD), preferably wherein two, three or all of Y3, Y10, Y14 and Y15 have been sulfated, and a second isolated sulfated polypeptide comprising SEQ ID NO:26 (CCR5_MACMU_TRD), preferably wherein two, three or all of Y3, Y10, Y14 and Y15 have been sulfated, or f) a first isolated sulfated polypeptide comprising SEQ ID NO:31 (CCR6_HUMAN_TRD), preferably wherein at least two or three of Y18, Y26 and Y27 have been sulfated, and a second isolated sulfated polypeptide comprising SEQ ID NO:32 (CCR6_MACFA_TRD), preferably wherein at least two or three of Y23, Y31 and Y32 have been sulfated, or g) a first isolated sulfated polypeptide comprising SEQ ID NO:37 (CCR7_HUMAN_TRD), preferably wherein one or both of Y8 and Y17 have been sulfated, and a second isolated sulfated polypeptide comprising SEQ ID NO:38 (CCR7_MACFA_TRD), preferably wherein one or both of Y8 and Y17 have been sulfated, or h) a first isolated sulfated polypeptide comprising SEQ ID NO:43 (CCR8_HUMAN_TRD), preferably wherein at least two or all of Y3, Y15 and Y17 have been sulfated, and a second isolated sulfated polypeptide comprising SEQ ID NO:44 (CCR8_MACFA_TRD), preferably wherein at least two or all of Y3, Y15 and Y17 have been sulfated, or i) a first isolated sulfated polypeptide comprising SEQ ID NO:61 (CCR9_HUMAN_TRD), preferably also Y17 and/or Y37 has been sulfated, and a second isolated sulfated polypeptide comprising SEQ ID NO:62 (CCR9_MACFA_TRD), preferably wherein at least Y28, and preferably also Y17 and/or Y37 has been sulfated, or j) a first isolated sulfated polypeptide comprising SEQ ID NO:67 (CCR10_HUMAN_TRD), preferably wherein at least one or both of Y14 and Y22 has been sulfated, and a second isolated sulfated polypeptide comprising SEQ ID NO:68 (CCR10_MACFA_TRD), preferably wherein at least one or both of Y14 and Y22 has been sulfated, or k) a first isolated sulfated polypeptide comprising SEQ ID NO:73 (CXCR1_HUMAN_TRD), preferably wherein Y27 has been sulfated, and a second isolated sulfated polypeptide comprising SEQ ID NO:74 (CXCR1_MACFA_TRD), preferably wherein at least one of Y14 and Y28 has been sulfated, or l) a first isolated sulfated polypeptide comprising SEQ ID NO:79 (CXCR2_HUMAN_TRD), preferably wherein Y23 and/or Y25 have been sulfated, and a second isolated sulfated polypeptide comprising SEQ ID NO:80 (CXCR2_MACFA_TRD), preferably wherein Y20 and/or Y22 have been sulfated, or m) a first isolated sulfated polypeptide comprising SEQ ID NO:85 (CXCR3_HUMAN_TRD), preferably wherein at least one or both of Y27 and Y29 have been sulfated, and a second isolated sulfated polypeptide comprising SEQ ID NO:86 (CXCR3_MACFA_TRD), preferably wherein at least one or both of Y27 and Y29 have been sulfated, or n) a first isolated sulfated polypeptide comprising SEQ ID NO:91 (CXCR4_HUMAN_TRD), preferably wherein at least Y12 and/or Y21 have been sulfated, and a second isolated sulfated polypeptide comprising SEQ ID NO:92 (CXCR4_MACFA_TRD), preferably wherein at least Y12 and/or Y21 have been sulfated, or o) a first isolated sulfated polypeptide comprising SEQ ID NO:97 (CXCR5_HUMAN_TRD), preferably wherein at least one of Y3 and Y27 have been sulfated, and a second isolated sulfated polypeptide comprising SEQ ID NO:98 (CXCR5_MACFA_TRD), preferably wherein at least one of Y3 and Y27 have been sulfated, or p) a first isolated sulfated polypeptide comprising SEQ ID NO:103 (CXCR6_HUMAN_TRD), preferably wherein at least one or both of Y6 and Y10 has been sulfated, and a second isolated sulfated polypeptide comprising SEQ ID NO:104 (CXCR6_MACFA_TRD), preferably wherein at least two or all of Y4, Y7 and Y39 have been sulfated q) a first isolated sulfated polypeptide comprising SEQ ID NO:157 (CX3CR1_HUMAN_TRD), preferably wherein at least Y14 has been sulfated, and a second isolated sulfated polypeptide comprising SEQ ID NO:158 (CX3CR1_MACFA_TRD), preferably wherein at least Y20 has been sulfated, or r) a first isolated sulfated polypeptide comprising SEQ ID NO:163 (CXCR1_HUMAN_TRD), preferably wherein at least Y27 has been sulfated, and a second isolated sulfated polypeptide comprising SEQ ID NO:164 (CXCR1_MACMU_TRD), preferably wherein at least Y14 has been sulfated.

According to some embodiments B of the fifth embodiments of the 6$^{th}$ aspect, the antibody or fragment specifically binds to a) a first isolated sulfated polypeptide comprising SEQ ID NO:4 (CCR1_HUMAN_N term), preferably wherein at least Y10 and/or Y18 have been sulfated, and a second isolated sulfated polypeptide comprising SEQ ID NO:5 (CCR1_MACFA_N term), preferably wherein at least Y10 and/or Y18 have been sulfated, b) a first isolated sulfated polypeptide comprising SEQ ID NO:10 (CCR2_HUMAN_N term), preferably wherein at least Y26 has been sulfated, and a second isolated sulfated polypeptide comprising SEQ ID NO:11 (CCR2_MACMU_N term), preferably wherein at least Y26 has been sulfated, c) a first isolated sulfated polypeptide comprising SEQ ID NO:16 (CCR3HUMAN_N term), preferably wherein Y16 and/or Y17 have been sulfated, and a second isolated sulfated polypeptide comprising SEQ ID NO:17 (CCR3_MACFA_N term), preferably wherein Y16 has been sulfated, d) a first isolated sulfated polypeptide comprising SEQ ID NO:22 (CCR4_HUMAN_N term), preferably wherein at least Y22 has been sulfated and preferably furthermore Y16, Y19 and/or Y20 have been sulfated, and a second isolated sulfated polypeptide comprising SEQ ID NO:23 (CCR4_MACFA_N term), preferably wherein at least Y22 has been sulfated and preferably furthermore Y16, Y19 and/or Y20 have been sulfated, e) a first isolated sulfated polypeptide comprising SEQ ID NO:28 (CCR5_HUMAN_N term), preferably wherein two, three or all of Y3, Y10, Y14 and Y15 have been sulfated, and a second isolated sulfated polypeptide comprising SEQ ID NO:29 (CCR5_MACMU_N term), preferably wherein two, three or all of Y3, Y10, Y14 and Y15 have been sulfated, f) a first isolated sulfated polypeptide comprising SEQ ID NO:34 (CCR6_HUMAN_N term), preferably wherein at least two or three of Y18, Y26 and Y27 have been sulfated, and a second isolated sulfated polypeptide comprising SEQ ID NO:35 (CCR6_MACFA_N term), preferably wherein at least two or three of Y23, Y31 and Y32 have been sulfated, g) a first isolated sulfated polypeptide comprising SEQ ID NO:40 (CCR7_HUMAN_N term), preferably wherein one or both of Y8 and Y17 have been sulfated, and a second isolated sulfated polypeptide comprising SEQ ID NO:41 (CCR7_MACFA_N term), preferably wherein one or both of Y8 and Y17 have been sulfated, h) a first isolated sulfated polypeptide comprising SEQ ID NO:46 (CCR8_HUMAN_N term with C=X or S), preferably wherein at least two or all of Y3, Y15 and Y17 have been sulfated, and a second isolated sulfated polypeptide comprising SEQ ID NO:47 (CCR8_MACFA_N term with C=X or S), preferably wherein at least two or all of Y3, Y15 and Y17 have been sulfated, i) a first isolated sulfated polypeptide comprising SEQ ID NO:64 (CCR9_HUMAN_N term), preferably wherein at least Y28, and preferably also Y17 and/or Y37 have been sulfated, and a second isolated sulfated polypeptide comprising SEQ ID NO:65 (CCR9_MACFA_N term), preferably wherein at least Y28, and preferably also Y17 and/or Y37 has been sulfated, j) a first isolated sulfated polypeptide comprising SEQ ID NO:70 (CCR10_HUMAN_N term), preferably wherein at least one or both of Y14 and Y22 have been sulfated, and a second isolated sulfated polypeptide comprising SEQ ID NO:71 (CCR10_MACFA_N term), preferably wherein at least one or both of Y14 and Y22 has been sulfated, k) a first isolated sulfated polypeptide comprising SEQ ID NO:76 (CXCR1_HUMAN_N term), preferably wherein Y27 has been sulfated, and a second isolated sulfated polypeptide comprising SEQ ID NO:77 (CXCR1_MACFA_N term), preferably wherein at least one of Y14 and Y28 has been sulfated, l) a first isolated sulfated polypeptide comprising SEQ ID NO:82 (CXCR2_HUMAN_N term), preferably wherein Y23 and/or Y25 have been sulfated, and a second isolated sulfated polypeptide comprising SEQ ID NO:83 (CXCR2_MACFA_N term), preferably wherein Y20 and/or Y22 have been sulfated, m) a first isolated sulfated polypeptide comprising SEQ ID NO:88 (CXCR3_HUMAN_N term), preferably wherein at least one or both of Y27 and Y29 have been sulfated, and a second isolated sulfated polypeptide comprising SEQ ID NO:89 (CXCR3_MACFA_N term), preferably wherein at least one or both of Y27 and Y29 have been sulfated, n) a first isolated sulfated polypeptide comprising SEQ ID NO:94 (CXCR4_HUMAN_N term), preferably wherein at least Y12 and/or Y21 have been sulfated, and a second isolated sulfated polypeptide comprising SEQ ID NO:95 (CXCR4_MACFA_N term), preferably wherein at least Y12 and/or Y21 have been sulfated, o) a first isolated sulfated polypeptide comprising SEQ ID NO:100 (CXCR5_HUMAN_N term), preferably wherein at least one of Y3 and Y27 have been sulfated, and a second isolated sulfated polypeptide comprising SEQ ID NO:101 (CXCR5_MACFA_N term), preferably wherein at least one of Y3 and Y27 have been sulfated, or p) a first isolated sulfated polypeptide comprising SEQ ID NO:106 (CXCR6_HUMAN_N term), preferably wherein at least one or both of Y6 and Y10 have been sulfated, and a second isolated sulfated polypeptide comprising SEQ ID NO:107 (CXCR6_MACFA_N term), preferably wherein at least two or all of Y4, Y7 and Y39 have been sulfated, or q) a first isolated sulfated polypeptide comprising SEQ ID NO:160 (CX3CR1_HUMAN_N term), preferably wherein at least Y14 has been sulfated, and a second isolated sulfated polypeptide comprising SEQ ID NO:161 (CX3CR1_MACFA_N term), preferably wherein at least Y20 or Y22 has been sulfated, or r) a first isolated sulfated polypeptide comprising SEQ ID NO:166 (CXCR1_HUMAN_N term), preferably wherein at least Y27 has been sulfated, and a second isolated sulfated polypeptide comprising SEQ ID NO:167 (CXCR1_MACMU_N term), preferably wherein at least Y14 or Y28 has been sulfated.

According to some embodiments C1 of the fifth embodiments of the $6^{th}$ aspect, the antibody or fragment specifically binds to a first isolated sulfated polypeptide comprising a sequence according to some embodiments A of the third embodiments of the $6^{th}$ aspect and binds to a second isolated sulfated polypeptide comprising a sequence according to some embodiments B or C of the third embodiments of the $6^{th}$ aspect, wherein preferably the first and the second polypeptide comprise the TRD of the same receptor but from different species.

According to some embodiments C2 of the fifth embodiments of the $6^{th}$ aspect, the antibody or fragment specifically binds to a first isolated sulfated polypeptide comprising a sequence according to some embodiments A of the fourth embodiments of the $6^{th}$ aspect and binds to a second isolated sulfated polypeptide comprising a sequence according to some embodiments B or C of the fourth embodiments of the $6^{th}$ aspect, wherein preferably the first and the second polypeptide comprise the TRD of the same receptor but from different species.

According to some sixth embodiments of the $6^{th}$ aspect, which may be or may not be the same as the first, second, third, fourth and/or fifth embodiments according to the $6^{th}$ aspect, the dissociation constant or the EC50 of the antibody or antigen-binding fragment for binding the first isolated sulfated polypeptide and/or for binding said seven transmembrane receptor is below 200 nM, 150 nM, 100 nM, 10 nM, 5 nM, 2.5 nM, 1 nM, 0.5 nM or 0.25 nM.

According to some embodiments A of the sixth embodiments of the $6^{th}$ aspect, the dissociation constant or the EC50 of the antibody or antigen-binding fragment for binding the first isolated sulfated polypeptide and/or for binding said seven transmembrane receptor is below 200 nM, 199 nM, 198 nM, 197 nM, 196 nM, 195 nM, 194 nM, 193 nM, 192 nM, 191 nM, 190 nM, 189 nM, 188 nM, 187 nM, 186 nM, 185 nM, 184 nM, 183 nM, 182 nM, 181 nM, 180 nM, 179 nM, 178 nM, 177 nM, 176 nM, 175 nM, 174 nM, 173 nM, 172 nM, 171 nM, 170 nM, 169 nM, 168 nM, 167 nM, 166 nM, 165 nM, 164 nM, 163 nM, 162 nM, 161 nM, 160 nM, 159 nM, 158 nM, 157 nM, 156 nM, 155 nM, 154 nM, 153 nM, 152 nM, 151 nM, 150 nM, 149 nM, 148 nM, 147 nM, 146 nM, 145 nM, 144 nM, 143 nM, 142 nM, 141 nM, 140 nM, 139 nM, 138 nM, 137 nM, 136 nM, 135 nM, 134 nM, 133 nM, 132 nM, 131 nM, 130 nM, 129 nM, 128 nM, 127 nM, 126 nM, 125 nM, 124 nM, 123 nM, 122 nM, 121 nM, 120 nM, 119 nM, 118 nM, 117 nM, 116 nM, 115 nM, 114 nM, 113 nM, 112 nM, 111 nM, 110 nM, 109 nM, 108 nM, 107 nM, 106 nM, 105 nM, 104 nM, 103 nM, 102 nM, 101 nM, 100 nM, 99 nM, 98 nM, 97 nM, 96 nM, 95 nM, 94 nM, 93 nM, 92 nM, 91 nM, 90 nM, 89 nM, 88 nM, 87 nM, 86 nM, 85 nM, 84 nM, 83 nM, 82 nM, 81 nM, 80 nM, 79 nM, 78 nM, 77 nM, 76 nM, 75 nM, 74 nM, 73 nM, 72 nM, 71 nM, 70 nM, 69 nM, 68 nM, 67 nM, 66 nM, 65 nM, 64 nM, 63 nM, 62 nM, 61 nM, 60 nM, 59 nM, 58 nM, 57 nM, 56 nM, 55 nM, 54 nM, 53 nM, 52 nM, 51 nM, 50 nM, 49 nM, 48 nM, 47 nM, 46 nM, 45 nM, 44 nM, 43 nM, 42 nM, 41 nM, 40 nM, 39 nM, 38 nM, 37 nM, 36 nM, 35 nM, 34 nM, 33 nM, 32 nM, 31 nM, 30 nM, 29 nM, 28 nM, 27 nM, 26 nM, 25 nM, 24 nM, 23 nM, 22 nM, 21 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, 1 nM, 0.9 nM, 0.8 nM, 0.7 nM, 0.6 nM, 0.5 nM, 0.4 nM, 0.3 nM, 0.25 nM, 0.2 nM, 0.15 nM, or 0.1 nM.

Preferably, the dissociation constant or the EC50 of the antibody or antigen-binding fragment for binding the first isolated sulfated polypeptide and/or for said seven transmembrane receptor is below 10 nM, 5 nM, 2.5 nM, 1 nM, 0.5 nM, 0.25 nM, 0.2 nM, 0.15 nM, or 0.1 nM.

Preferably, EC50 can be determined in CHO cells overexpressing the target. As disclosed for instance in example 10.1.1, the antibodies obtained with a method disclosed herein have excellent affinities for their respective target. For example, TPP-21181, TPP-17578, TPP-19546, TPP-18206, TPP-21360 and TPP-23411 bound human CCR8 with an EC50 of 4.8 nM, 1.7 nM, 0.8 nM, 0.6 nM, ~0.9 nM or 1.7 nM in CHO cells engineered to overexpress CCR8. Also, TPP-21181, TPP-17578, TPP-19546, TPP-18206, TPP-21360 and TPP-23411 bound cynomolgus CCR8 with an EC50 of 1.8 nM, 1 nM, 0.5 nM, 0.7 nM, ~0.55 nM or 0.9 nM. In addition, TPP-17578, TPP-19546, TPP-18206, and TPP-21360 bound to human regulatory T cells with an EC50 of 25 nM, 15 nM, 23 nM or 10 nM. In addition, anti-murine CCR8 antibody TPP-14099 binds CHO cells expressing murine CCR8 with an EC50 of 3 nM and murine iTregs with an EC50 of 13.2 nM, cf. Table 10.1.1.5.

According to some embodiments B of the sixth embodiments of the aspect, which may or may not be the same as the embodiments A of the sixth embodiments of the $6^{th}$ aspect, the dissociation constant or the EC50 of the antibody or antigen-binding fragment for binding the second isolated sulfated polypeptide and/or for binding the second seven transmembrane receptor is below 200 nM, 199 nM, 198 nM, 197 nM, 196 nM, 195 nM, 194 nM, 193 nM, 192 nM, 191 nM, 190 nM, 189 nM, 188 nM, 187 nM, 186 nM, 185 nM, 184 nM, 183 nM, 182 nM, 181 nM, 180 nM, 179 nM, 178 nM, 177 nM, 176 nM, 175 nM, 174 nM, 173 nM, 172 nM, 171 nM, 170 nM, 169 nM, 168 nM, 167 nM, 166 nM, 165 nM, 164 nM, 163 nM, 162 nM, 161 nM, 160 nM, 159 nM, 158 nM, 157 nM, 156 nM, 155 nM, 154 nM, 153 nM, 152 nM, 151 nM, 150 nM, 149 nM, 148 nM, 147 nM, 146 nM, 145 nM, 144 nM, 143 nM, 142 nM, 141 nM, 140 nM, 139 nM, 138 nM, 137 nM, 136 nM, 135 nM, 134 nM, 133 nM, 132 nM, 131 nM, 130 nM, 129 nM, 128 nM, 127 nM, 126 nM, 125 nM, 124 nM, 123 nM, 122 nM, 121 nM, 120 nM, 119 nM, 118 nM, 117 nM, 116 nM, 115 nM, 114 nM, 113 nM, 112 nM, 111 nM, 110 nM, 109 nM, 108 nM, 107 nM, 106 nM, 105 nM, 104 nM, 103 nM, 102 nM, 101 nM, 100 nM, 99 nM, 98 nM, 97 nM, 96 nM, 95 nM, 94 nM, 93 nM, 92 nM, 91 nM, 90 nM, 89 nM, 88 nM, 87 nM, 86 nM, 85 nM, 84 nM, 83 nM, 82 nM, 81 nM, 80 nM, 79 nM, 78 nM, 77 nM, 76 nM, 75 nM, 74 nM, 73 nM, 72 nM, 71 nM, 70 nM, 69 nM, 68 nM, 67 nM, 66 nM, 65 nM, 64 nM, 63 nM, 62 nM, 61 nM, 60 nM, 59 nM, 58 nM, 57 nM, 56 nM, 55 nM, 54 nM, 53 nM, 52 nM, 51 nM, 50 nM, 49 nM, 48 nM, 47 nM, 46 nM, 45 nM, 44 nM, 43 nM, 42 nM, 41 nM, 40 nM, 39 nM, 38 nM, 37 nM, 36 nM, 35 nM, 34 nM, 33 nM, 32 nM, 31 nM, 30 nM, 29 nM, 28 nM, 27 nM, 26 nM, 25 nM, 24 nM, 23 nM, 22 nM, 21 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, 1 nM, 0.9 nM, 0.8 nM, 0.7 nM, 0.6 nM, 0.5 nM, 0.4 nM, 0.3 nM, 0.25 nM, 0.2 nM, 0.15 nM, or 0.1 nM.

Preferably, the dissociation constant (KD) or the EC50 of the antibody or antigen-binding fragment for binding the second isolated sulfated polypeptide and/or for binding the second seven transmembrane receptor is below 10 nM, 5 nM, 2.5 nM, 1 nM, 0.5 nM or 0.25 nM.

According to some embodiments AB of the sixth embodiments of the $6^{th}$ aspect, the dissociation constant (KD) or the EC50 of the antibody or antigen-binding fragment for binding the first isolated sulfated polypeptide and/or the first seven transmembrane receptor is below 10 nM, 5 nM, 2.5 nM, 1 nM, 0.5 nM or 0.25 nM and the dissociation constant (KD) or the EC50 of the antibody or antigen-binding fragment for binding the second isolated sulfated polypeptide and/or the second seven transmembrane receptor is below 10 nM, 5 nM, 2.5 nM, 1 nM, 0.5 nM or 0.25 nM.

According to some seventh embodiments of the $6^{th}$ aspect, which may be or may not be the same as the first, second, third, fourth, fifth and/or sixth embodiments according to the $6^{th}$ aspect, the dissociation constant (KD) of the antibody for binding the first isolated sulfated polypeptide is lower than the dissociation constant (KD) of the antibody for binding a first isolated non-sulfated polypeptide having the same sequence as the first isolated sulfated polypeptide. Preferably, the antibody does not substantially bind a first isolated non-sulfated polypeptide having the same sequence as the first isolated sulfated polypeptide.

According to some embodiments A of the seventh embodiments of the $6^{th}$ aspect, the dissociation constant or the EC50 of the antibody for binding the first isolated non-sulfated polypeptide is higher than 100 nM, 150 nM, 200 nM, 250 nM, 300 nM, 350 nM, 400 nM, 450 nM, 500 nM, 600 nM, 700 nM, 800 nM, 900 nM, 1 µM, 1.25 µM, 1.5 µM, 1.75 µM, 2 µM, 2.25 µM, 2.5 µM, 2.75 µM, or 3 µM, or is not detectable. Preferably, the dissociation constant or the EC50 of the antibody for binding the first isolated non-sulfated polypeptide is higher than 100 nM, 250 nM, 500 nM, 1 µM, 2 µM or 3 µM, or is not detectable.

According to some embodiments B of the seventh embodiments of the $6^{th}$ aspect, which may be the same as the embodiments A of the seventh embodiments of the $6^{th}$ aspect, the dissociation constant or the EC50 of the antibody or fragment for binding the first isolated sulfated polypeptide is below 10 nM, 5 nM, 2.5 nM, 1 nM, 0.5 nM or 0.25 nM, and the dissociation constant or the EC50 of the antibody or fragment for binding the first isolated non-sulfated polypeptide is higher than 10 nM, 25 nM, 50 nM, 100 nM, 250 nM or 500 nM, or is not detectable.

The antibody according to the $6^{th}$ aspect may comprise CDRs derived from human, monkey, Macaca fascicularis (cynomolgus monkey), Macaca mulatta (Rhesus macaque), rodent, mouse, rat, horse, bovine, pig, dog, cat and camel. Preferably, the antibody according to the $6^{th}$ aspect comprises human, rat or mouse derived CDRs.

According to some $8^{th}$ embodiments of the $6^{th}$ aspect, which may be and are suggested to be combined with the first, second, third, fourth, fifth, sixth and/or seventh embodiments of the sixth aspect, the isolated antibody or antigen-binding fragment comprises human derived CDRs. According to some highly preferred embodiments, the human derived CDRs comprise no deviations or less than 1, 2, 3, 4, 5, 6, 7, 8, 9, 10, 11, 12, 13, 14 or 15 deviations from the closest human germline. The closest human germline may be determined as known in the art, e.g. in silico using IgBLAST (Ye, Jian, et al. "IgBLAST: an immunoglobulin variable domain sequence analysis tool." Nucleic acids research 41.W1 (2013): W34-W40.) with data retrieved from the IMGT human germline database. The antibodies according to these $8^{th}$ embodiments can be obtained as described e.g. in example 6 or 8, or as described elsewhere herein.

According to some $9^{th}$ embodiments of the $6^{th}$ aspect, which may be and are suggested to be combined with the first, second, third, fourth, fifth, sixth, seventh, or $8^{th}$ embodiments of the $6^{th}$ aspect, the isolated antibody or antigen-binding fragment is cross reactive for human and cynomolgus, cf. example 10.1.1. Preferably, the dissociation constant (KD) or the EC50 of the antibody or antigen-binding fragment for binding a human chemokine receptor is below 200 nM, 150 nM, 100 nM, 10 nM, 5 nM, 2.5 nM, 1 nM, 0.5 or 0.25 nM, such as below 10 nM, 5 nM, 2.5 nM, 1 nM, 0.5 or 0.25 nM. Preferably, the dissociation constant (KD) or the EC50 of the antibody or antigen-binding fragment for binding a cynomolgus chemokine receptor is below 10 nM, 5 nM, 2.5 nM, 1 nM, 0.5 or 0.25 nM.

According to some $10^{th}$ embodiments of the $6^{th}$ aspect, which may be and are suggested to be combined with the first, second, third, fourth, fifth, sixth, seventh, $8^{th}$, and/or $9^{th}$ embodiments of the $6^{th}$ aspect, the isolated antibody or antigen-binding fragment is characterized by a HCDR3 region deviating in composition from average HCDR3 regions. Preferably the isolated antibody or antigen-binding fragment is characterized by a HCDR3 region comprising between 10 and 34% of tyrosine and/or at least one histidine, preferably between 2 and 20% of histidine, most preferably between 7 and 20% of histidine.

In some embodiments A of the $10^{th}$ embodiments of the $6^{th}$ aspect, the isolated antibody or antigen-binding fragment comprises a HCDR3 having
a) >0 and <35%, >8 and <34%, ≥10 and <34%, or >15 and <31% tyrosine (Y) residues, and/or
b) >0 and ≤16%, ≥2 and ≤20% or ≥7 and ≤20% histidine (H) residues, and
c) preferably >0 and ≤18%, ≥7 and ≤10% or ≥0 and ≤7% arginine (R) residues, and/or
d) preferably >0 and ≤25%, ≥7 and ≤16% or ≥7 and ≤13% aspartic acid (D) residues, and/or
e) preferably no lysine (K) residues, and/or
f) preferably no glutamic acid (E) residues.

In some embodiments B of the $10^{th}$ embodiments of the $6^{th}$ aspect, which may be the same as or different from the embodiments A, the isolated antibody or antigen-binding fragment comprises a HCDR3 having
a) >0 and <47%, >22 and <50%, >10 and <34%, or >15 and <47% charged amino acids, and/or
b) >0 and <32%, >8 and <30%, or >10 and <37% positively charged amino acids, and/or
c) >0 and <26%, ≥7 and <16%, or >7 and <14% negatively charged amino acids.

In some embodiments C of the $10^{th}$ embodiments of the $6^{th}$ aspect, which may be the same as or different from embodiments A and/or B, the isolated antibody or antigen-binding fragment comprises a HCDR3 having >0 and ≤42%, >10 and ≤42% or ≥36 and ≤43% histidine and tyrosine residues in total.

Each of the embodiments and descriptions disclosed for CCR8 according to aspect 10 is disclosed herein for chemokine receptor antibodies in general, e.g. with the necessary changes. The inventors believe that the sulfated TRD motif rather than the specific CCR8 sequence promotes the increased frequencies for tyrosine and/or histidine.

According to some $11^{th}$ embodiments of the $6^{th}$ aspect, which may be and are suggested to be combined with the first, second, third, fourth, fifth, sixth, seventh, eighth, ninth, and/or $10^{th}$ embodiments of the $6^{th}$ aspect, the isolated antibody or antigen-binding fragment at least partially modulates CCR8 signaling. For example, an antibody according to the current invention can
a) block G-protein independent signaling, and/or
b) block G-protein dependent signaling, and/or
c) block G-protein dependent and G-protein independent signaling, and/or
d) increase G-protein independent signaling, and/or
e) increase G-protein dependent signaling, and/or
f) increase G-protein dependent and G-protein independent signaling.

In the particular context, modulation refers to blocking of ligand induced G-protein independent signaling and induction of G-protein independent signaling.

According to some preferred embodiments, the antibody or fragment does not modulate G protein independent signaling of the seven transmembrane receptor. According to some preferred embodiments, the antibody or fragment does not block ligand induced G-protein independent signaling of the target protein. According to some preferred embodiments, the antibody or fragment does not induce G-protein independent signaling According to some preferred embodiments, the antibody or fragment blocks G protein dependent signaling. G protein dependent signaling can be analyzed by chemotaxis assay or preferably by calcium flux assay, as described elsewhere herein.

According to some preferred embodiments, the antibody or fragment blocks G protein dependent signaling of the chemokine receptor but does not block G protein independent signaling of the chemokine receptor, cf. example 10.4. G protein independent signaling of the chemokine receptor is any signaling activity which is not G protein dependent signaling.

According to some $12^{th}$ embodiments of the $6^{th}$ aspect, which may be and are suggested to be combined with the first, second, third, fourth, fifth, sixth, seventh, $8^{th}$, $9^{th}$, $10^{th}$ and $11^{th}$ embodiments of the $6^{th}$ aspect, the isolated antibody or antigen-binding fragment is a low internalizing or non-internalizing antibody or antigen binding fragment.

Because overexpression may impact the internalization behavior and is less suited to model internalization in a therapeutic setting, internalization is preferably determined using a model cell line with endogenous expression of the target chemokine receptor, cf. example 10.5. For example, internalization can be determined over a time frame or for specific time points. Preferably internalization can be determined after 15 min, 30 min, 1 h, 2 h, 3 h, 6 h, 12 h, 24 h or 48 h in a cell endogenously expressing the target.

According to some embodiments A of the 12th embodiments of the 6th aspect, the antibody or antigen-binding fragment has an internalization rate in the same order of magnitude as the internalization rate of the isotype control.

According to some embodiments B of the 12th embodiments of the 6th aspect, the antibody or antigen-binding fragment is characterized by an internalization into a cell with endogenous target expression which is lower than the 1.5, 2, 3, 4, 5, 6, 7, or 10-fold of the internalization of the isotype control. The isotype control for an antibody can be selected as known in the art to match the isotype of the antibody as closely as possible, but without binding to the target.

According to some embodiments C of the 12th embodiments of the 6th aspect, the antibody or antigen-binding fragment is characterized by an internalization into a cell with endogenous target expression which is lower than 150%, 175%, 200%, 300%, 400% or 500% of the internalization of the isotype control e.g. after 15 min, 30 min, 1 h, 2 h, 3 h, 6 h, 12 h, 24 h or 48 h.

According to some $13^{th}$ embodiments of the $6^{th}$ aspect, which may be and are suggested to be combined with the first, second, third, fourth, fifth, sixth, seventh, $8^{th}$, $9^{th}$, $10^{th}$, $11^{th}$ and/or $12^{th}$ embodiments of the $6^{th}$ aspect, the isolated antibody or antigen-binding fragment induces ADCC and/or ADCP of cells expressing the target receptor of the antibody.

In some preferred embodiments of the 13th embodiments of the 6th aspect, the antibody or antigen-binding fragment is afucosylated.

In some embodiments A1 of the 13$^{th}$ embodiments of the 6th aspect, the antibody or antigen-binding fragment binds to human Fc gamma receptor IIIA variant V176 (CD16a) with a dissociation constant (KD) lower than 530 nM, 500 nM, 450 nM, 400 nM, 300 nM or 200 nM. Preferably, the KD can be determined using surface plasmon resonance.

In some embodiments B1 of the 13$^{th}$ embodiments of the 6th aspect, which may be the same as or different from the embodiments A1, the antibody or antigen-binding fragment induces antibody-dependent cell-mediated cytotoxicity (ADCC) in target cells expressing the target receptor via human effector cells, such as human NK cells. ADCC induction can be analyzed with an assay known in the art, for example as described according to examples 10.3.3 ff. or elsewhere herein. Preferably the assay is performed with Treg cells wherein at least 80% or 85% of the Treg cells express CCR8.

In some embodiments C1 of the 13$^{th}$ embodiments of the 6th aspect, which may be the same as or different from the embodiments A1 or B1, the ADCC-induced maximal depletion of cells expressing the target receptor is at least 30%, 35%, 40%, 45%, 50%, 55%, 60%, 70%, 80%, 90%, 95%, 98% or 99%.

In some embodiments D1 of the 13$^{th}$ embodiments of the 6th aspect, which may be the same as or different from the embodiments A1, B1 or C1, the EC50 for ADCC-induced depletion of target expressing cells is below 500 µM, 400 µM, 300 µM, 200 µM, 100 µM, 50 µM, 25 µM, 20 µM, 12.5 µM, 10 µM, 5 µM or 2.5 µM.

In some embodiments A2 of the 13$^{th}$ embodiments of the 6th aspect, which may or may not be the same as the embodiments A1, B1, C1 and/or D1, the antibody or antigen-binding fragment binds to human Fc gamma RITA (CD32a) with a dissociation constant (KD) lower than 30 µM, 20 µM, 10 µM, 5 µM or 1 µM.

In some embodiments B2 of the 13$^{th}$ embodiments of the 6th aspect, which may be the same as the embodiments A1, B1, C1 and/or D1, and which may be the same as the embodiments A2, the antibody or antigen-binding fragment induces antibody-dependent cell-mediated phagocytosis (ADCP) in cells expressing the target receptor via human effector cells, such as human macrophages. For example, the human macrophages can be M2 or M1 macrophages.

In some embodiments C2 of the 13$^{th}$ embodiments of the 6th aspect, which may be the same as the embodiments A1, B1, C1 and/or D1, and which may be the same as the embodiments A2 and/or B2, the ADCP-induced maximal depletion of cells expressing the target receptor is at least 5, 10, 15, 20, 25, 30, 40 or 50%.

In some embodiments D2 of the 13$^{th}$ embodiments of the 6th aspect, which may be the same as the embodiments A1, B1, C1 and/or D1, and which may be the same as the embodiments A2, B2, and/or C2, the EC50 for ADCP-induced depletion of activated human regulatory T cells is below 1500 µM, 1000 µM, 500 µM, 250 µM, 200 µM, 150 µM, 100 µM, 75 µM, 50 µM, 25 µM or 10 µM.

In some preferred of the 13$^{th}$ embodiments of the 6th aspect, there is provided an isolated antibody or antigen-binding fragment thereof, specifically binding to a chemokine receptor, wherein the antibody or antigen-binding fragment a) binds to human Fc gamma receptor IIIA variant V176 (CD16a) with a dissociation constant (KD) lower than 530 nM, 500 nM, 450 nM, 400 nM, 300 nM or 200 nM, and/or
b) binds to human Fc gamma RITA (CD32a) with a dissociation constant (KD) lower than 30 µM, 20 µM, 10 µM, 5 µM or 1 µM.

In some preferred of the 13$^{th}$ embodiments of the 6th aspect, there is provided an isolated antibody or antigen-binding fragment thereof, specifically binding to a chemokine receptor, wherein the antibody or antigen-binding fragment
a) induces antibody-dependent cell-mediated cytotoxicity (ADCC) in target cells expressing the human chemokine receptor via human effector cells, such as human NK cells, and/or
b) induces antibody-dependent cell-mediated phagocytosis (ADCP) in target cells expressing the human chemokine receptor via human effector cells, such as human macrophages.

In some preferred of the 13$^{th}$ embodiments of the 6th aspect, there is provided an isolated antibody or antigen-binding fragment thereof, specifically binding to a chemokine receptor, wherein
a) the ADCC-induced maximal depletion in target cells expressing the human chemokine receptor is at least 25%, 30%, 35%, 40%, 45%, 50%, 55%, 60%, 70%, 80%, 90%, 95%, 98% or 99%, and/or
b) the ADCP-induced maximal depletion in target cells expressing the human chemokine receptor is at least 5%, 10%, 15%, 20%, 25%, 30%, 40% or 50%, and/or
c) the maximal depletion of target cells expressing the human chemokine receptor, is at least 30%, 35%, 40%, 45%, 50%, 55%, 60%, 70%, 80%, 90%, 95% or 99%.

In some preferred of the 13$^{th}$ embodiments of the 6th aspect, there is provided an isolated antibody or antigen-binding fragment thereof, specifically binding to a chemokine receptor, wherein
a) the EC50 for ADCC-induced depletion of target cells expressing the human chemokine receptor is below 200 µM, 100 µM, 50 µM, 25 µM, 12.5 µM, 10 µM or 5 µM and/or
b) the EC50 for ADCP-induced depletion of target cells expressing the human chemokine receptor is below 500 µM, 250 µM, 200 µM, 150 µM, 100 µM, 75 µM, 50 µM or 25 µM.

According to some 14$^{th}$ embodiments of the 6$^{th}$ aspect, which may be and are suggested to be combined with the first, second, third, fourth, fifth, sixth, seventh, 8$^{th}$, 9$^{th}$, 10$^{th}$, 11$^{th}$, 12$^{th}$ and/or 13$^{th}$ embodiments of the 6$^{th}$ aspect, the isolated antibody or antigen-binding fragment comprises a human, rat or murine IgG antibody, preferably a human IgG1 antibody or a murine IgG2a antibody, cf. example 6 and 8. According to some 15th embodiments of the 6$^{th}$ aspect, which may be and are suggested to be combined with the first, second, third, fourth, fifth, sixth, seventh, 8$^{th}$, 9$^{th}$, 10$^{th}$, 11$^{th}$, 12$^{th}$, 13$^{th}$ and/or 14$^{th}$ embodiments of the 6$^{th}$ aspect, the isolated antibody or antigen-binding fragment is an scFv, Fab, Fab' or a F(ab')2 fragment, cf. example 6.

The antibodies according to the current aspect can be conjugated, e.g. as discussed elsewhere herein. The antibodies according to the current aspect can be used in the treatment of a tumor or a disease characterized by the involvement of cells expressing the seven transmembrane receptor, e.g. as discussed elsewhere herein. The antibodies according to the current aspect can be used as a diagnostic agent in vivo or in vitro, e.g. as discussed elsewhere herein.

Furthermore, there is provided a kit comprising an antibody according to the current aspect with instructions for use.

Preferred Combinations According to the 6$^{th}$ Aspect

The following embodiments disclose preferred combinations of the sixth aspect, thereby emphasizing the modular nature of the invention. Provided according to a preferred embodiment I is an isolated antibody or antigen-binding fragment thereof, specifically binding to a first isolated sulfated polypeptide which comprises the tyrosine rich domain (TRD) of a seven transmembrane receptor, and optionally its LID domain, wherein at least 25%, at least 50% or at least 75% of the tyrosine residues of the TRD are sulfated. Provided according to a preferred embodiment II is the isolated antibody or antigen-binding fragment according to preferred embodiment I, wherein the cysteine between the TRD and the LID domain has been removed or has been exchanged into a different amino acid. Provided according to a preferred embodiment III is the isolated antibody or antigen-binding fragment according to preferred embodiment I or II, wherein the seven transmembrane receptor is a human, cynomolgus or mouse seven transmembrane receptor. Provided according to a preferred embodiment IV is the isolated antibody or antigen-binding fragment according to any of preferred embodiments I, II or III, wherein the seven transmembrane receptor is a) a CC chemokine receptor, preferably CCR1, CCR2, CCR3, CCR4, CCR5, CCR6, CCR7, CCR8, CCR9 or CCR10, b) a CXC chemokine receptor, preferably CXCR1, CXCR2, CXCR3, CXCR4, CXCR5, or CXCR6, or c) CX3CR1 or CXCR1. Provided according to a preferred embodiment V is an isolated antibody or antigen-binding fragment according to any of preferred embodiments I, II, III or IV, said first isolated sulfated polypeptide comprising or consisting of a sequence according to a. SEQ ID NO:1, SEQ ID NO:4, SEQ ID NO:2, SEQ ID NO:5, SEQ ID NO:3 or SEQ ID NO:6, preferably wherein at least Y10 and/or Y18 have been sulfated, or
b. SEQ ID NO:7, SEQ ID NO:10, SEQ ID NO:8 or SEQ ID NO:11, preferably wherein at least Y26 has been sulfated, or
c. SEQ ID NO:9 or SEQ ID NO:12, preferably wherein at least Y37 and/or Y39 has been sulfated, or
d. SEQ ID NO:13 or SEQ ID NO:16, preferably wherein Y16 and/or Y17 have been sulfated, or
e. SEQ ID NO:14 or SEQ ID NO:17, preferably wherein Y16 has been sulfated, or
f. SEQ ID NO:15 or SEQ ID NO:18 preferably wherein Y20 and/or Y22 have been sulfated, or
g. SEQ ID NO:19, SEQ ID NO:22, SEQ ID NO:20, SEQ ID NO:23, SEQ ID NO:21 or SEQ ID NO:24, preferably wherein at least Y22 has been sulfated and preferably furthermore Y16, Y19 and/or Y20 have been sulfated, or
h. SEQ ID NO:25, SEQ ID NO:28, SEQ ID NO:26 or SEQ ID NO:29, preferably wherein two, three or all of Y3, Y10, Y14 and Y15 have been sulfated, or
i. SEQ ID NO:27 or SEQ ID NO:30, preferably wherein two or three of Y10, Y12 and Y16 have been sulfated, or
j. SEQ ID NO:31 or SEQ ID NO:34, preferably wherein at least two or three of Y18, Y26 and Y27 have been sulfated, or
k. SEQ ID NO:32 or SEQ ID NO:35, preferably wherein at least two or three of Y23, Y31 and Y32 have been sulfated, or
l. SEQ ID NO:33 or SEQ ID NO:36, preferably wherein at least two or three of Y13, Y18 and Y19 have been sulfated, or
m. SEQ ID NO:37, SEQ ID NO:40, SEQ ID NO:38 or SEQ ID NO:41, preferably wherein one or both of Y8 and Y17 have been sulfated, or
n. SEQ ID NO:39 or SEQ ID NO:42, preferably wherein one or both of Y8 and Y17 and optionally Y20 have been sulfated, or
o. SEQ ID NO:43, SEQ ID NO:44, SEQ ID NO:46 or SEQ ID NO:47, preferably wherein at least two or all of Y3, Y15 and Y17 have been sulfated, or
p. SEQ ID NO:45 or SEQ ID NO:48, preferably wherein at least two or all of Y3, Y14 and Y15 have been sulfated, or
q. SEQ ID NO:61, SEQ ID NO:64, SEQ ID NO:62 or SEQ ID NO:65, preferably wherein at least Y28, and preferably also Y17 and/or Y37 has been sulfated, or
r. SEQ ID NO:63 or SEQ ID NO:66, preferably wherein at least Y28 has been sulfated, and preferably also Y19 has been sulfated, or
s. SEQ ID NO:67, SEQ ID NO:70, SEQ ID NO:68 or SEQ ID NO:71, preferably wherein at least one or both of Y14 and Y22 has been sulfated, or
t. SEQ ID NO:69 or SEQ ID NO:72, preferably wherein at least one, two or all of Y14, Y17 and Y22 has been sulfated, or
u. SEQ ID NO:73 or SEQ ID NO:76, preferably wherein Y27 has been sulfated, or
v. SEQ ID NO:74 or SEQ ID NO:77, preferably wherein at least one of Y14 and Y28 has been sulfated, or
w. SEQ ID NO:75 or SEQ ID NO:78, preferably wherein at least Y6 has been sulfated, or
x. SEQ ID NO:79 or SEQ ID NO:82, preferably wherein Y23 and/or Y25 have been sulfated, or
y. SEQ ID NO:80 or SEQ ID NO:83, preferably wherein Y20 and/or Y22 have been sulfated, or
z. SEQ ID NO:81 or SEQ ID NO:84, preferably wherein Y24 has been sulfated, or
aa. SEQ ID NO:85, SEQ ID NO:88, SEQ ID NO:86, SEQ ID NO:89, SEQ ID NO:87 or SEQ ID NO:90, preferably wherein at least one or both of Y27 and Y29 have been sulfated, or
bb. SEQ ID NO:91, SEQ ID NO:94, SEQ ID NO:92 or SEQ ID NO:95, preferably wherein at least Y12 and/or Y21 have been sulfated, or
cc. SEQ ID NO:93 or SEQ ID NO:96, preferably wherein at least Y23 and/or Y14 have been sulfated, or
dd. SEQ ID NO:97, SEQ ID NO:100, SEQ ID NO:98 or SEQ ID NO:101, preferably wherein at least one of Y3 and Y27 have been sulfated, or
ee. SEQ ID NO:99 or SEQ ID NO:102, preferably wherein at least Y3 and/or Y14 and/or Y20 and/or Y26 have been sulfated, or
ff. SEQ ID NO:103 or SEQ ID NO:106, preferably wherein at least one or both of Y6 and Y10 has been sulfated, or
gg. SEQ ID NO:104 or SEQ ID NO:107, preferably wherein at least two or all of Y4, Y7 and Y39 have been sulfated, or
hh. SEQ ID NO:105 or SEQ ID NO:108, preferably wherein at least one or both of Y11 and Y15 have been sulfated, or
ii. SEQ ID NO:157 or SEQ ID NO:160, preferably wherein at least Y14 has been sulfated, or
jj. SEQ ID NO:158, preferably wherein at least Y20 has been sulfated, or kk. SEQ ID NO:161, preferably wherein at least Y20 or Y22 has been sulfated, or
ll. SEQ ID NO:159 or SEQ ID NO:162, preferably wherein at least Y15 has been sulfated, or
mm. SEQ ID NO:163 or SEQ ID NO:166, preferably wherein at least Y27 has been sulfated, or
nn. SEQ ID NO:164, preferably wherein at least Y14 has been sulfated or
oo. SEQ ID NO:167, preferably wherein at least Y14 or Y28 has been sulfated, or
pp. SEQ ID NO:165 or SEQ ID NO:168, preferably wherein at least Y6 has been sulfated.

Provided according to a preferred embodiment VI is the isolated antibody or antigen-binding fragment according to any of preferred embodiments I, II, III, IV or V, wherein the dissociation constant or the EC50 of the antibody for binding the first isolated sulfated polypeptide and/or for said seven transmembrane receptor is below 150 nM, 100 nM, 10 nM, 5 nM, 2.5 nM, 1 nM, 0.5 or 0.25 nM. Provided according to a preferred embodiment VII is an isolated antibody or antigen-binding fragment according to any of preferred embodiments I to VI, wherein the isolated antibody or antigen-binding fragment specifically binds to a second isolated sulfated polypeptide which comprises the TRD of a seven transmembrane receptor, preferably wherein the seven transmembrane receptor of the TRD comprised by the second isolated sulfated polypeptide
a. is different from the seven transmembrane receptor of the TRD comprised by the first isolated sulfated polypeptide, or
b. is the corresponding seven transmembrane receptor of the TRD comprised by the first isolated sulfated polypeptide but from a different species.

Provided according to a preferred embodiment VIII is the isolated antibody or antigen-binding fragment according to preferred embodiment VII, wherein the dissociation constant or the EC50 of the antibody for binding the second isolated sulfated polypeptide and/or for binding the second seven transmembrane receptor is below 10 nM, 5 nM, 2.5 nM, 1 nM, 0.5 or 0.25 nM. Provided according to a preferred embodiment IX is an isolated antibody or antigen-binding fragment according to any of preferred embodiments I to VIII, wherein the dissociation constant (KD) of the antibody for binding the first isolated sulfated polypeptide is lower than the dissociation constant (KD) of the antibody for binding a first isolated non-sulfated polypeptide having the same sequence as the first isolated sulfated polypeptide. Provided according to a preferred embodiment X is the isolated antibody or antigen-binding fragment according to preferred embodiment IX, wherein the dissociation constant and/or EC50 of the antibody for binding the first isolated non-sulfated polypeptide is higher than 150 nM, 250 nM, 500 nM, 1 µM, 2 µM or 3 µM, or is not detectable. Provided according to a preferred embodiment XI is the isolated antibody or antigen-binding fragment according to any of preferred embodiments IX or X, wherein the dissociation constant or the EC50 of the antibody or fragment for binding the first isolated sulfated polypeptide is below 10 nM, 5 nM, 2.5 nM, 1 nM, 0.5 nM or 0.25 nM, and wherein the dissociation constant of the antibody or fragment for binding the first isolated non-sulfated polypeptide is higher than 10 nM, 25 nM, 50 nM, 100 nM, 250 nM or 500 nM, or is not detectable. Provided according to a preferred embodiment XII is the isolated antibody or antigen-binding fragment according to any of preferred embodiments I to XI, wherein the antibody comprises human, rat or mouse derived CDRs. Provided according to a preferred embodiment XIII is the isolated antibody or antigen-binding fragment according to any of preferred embodiments I to XII, wherein the antibody
a. comprises human derived CDRs, and/or
b. is cross reactive for human and cynomolgus, and/or
c. is characterized by a HCDR3 region comprising between 10 and 34% of tyrosine and/or between 2 and 20% of histidine, and/or
d. does not modulate G protein independent signaling of the seven transmembrane receptor, and/or
e. is a non-internalizing antibody or is characterized by an internalization into a cell with endogenous target expression which is lower than the 1.5, 2, 3, 4, 5, 6, 7, or 10-fold of the internalization of the isotype control, and/or
f. induces ADCC and/or ADCP
g. is a human, rat or murine IgG antibody, preferably a human IgG1 antibody or a murine IgG2a antibody, and/or
h. is an scFv, Fab, Fab' or a F(ab')2 fragment.

Provided according to a preferred embodiment XIV is a conjugate comprising an antibody or antigen-binding fragment according to any of preferred embodiments I to XIII, preferably wherein the conjugate comprises
a. a radioactive element,
b. a cytotoxic agent, such as an auristatin, a maytansinoid, a kinesin-spindle protein inhibitor, a nicotinamide phosphoribosyltransferase inhibitor or a pyrrolobenzodiazepine derivative,
c. a further antibody or antigen-binding fragment, or
d. a chimeric antigen receptor.

Provided according to a preferred embodiment XV is an antibody or antigen-binding fragment according to any of preferred embodiments I to XIII or a conjugate according to preferred embodiment XIV for use in the treatment of a tumor or a disease characterized by the involvement of cells expressing the seven transmembrane receptor, optionally in combination with an antibody targeting a checkpoint inhibitor. Provided according to a preferred embodiment XVI is the antibody or antigen-binding fragment according to any of preferred embodiments I to XIII or a conjugate according to preferred embodiment XIV for use as a diagnostic agent in vivo or in vitro. Provided according to a preferred embodiment XVII is a kit comprising an antibody or antigen-binding fragment according to any of preferred embodiments I to XIII or a conjugate according to preferred embodiment XIV with instructions for use.

Antibodies Binding CCR8

The following aspects 7, 8, 9, 10, 11, 12, 13, 14, 15, 16, 17 and 18 relate to antibodies specifically binding to CCR8. While each aspect is described individually, the different structural or functional aspects may be combined and are suggested to be combined with each other, except where obviously incompatible. Furthermore, each embodiment in each aspect may be combined with each embodiment in the same or in a different aspect, except where obviously incompatible.

If not explicitly stated otherwise, the CCR8 may be from any species e.g. human, monkey, *Macaca fascicularis* (cynomolgus monkey), *Macaca mulatta* (*Rhesus macaque*), rodent, mouse, rat, horse, bovine, pig, dog, cat and camel CCR8. Antibodies binding CCR8 from at least two species, wherein one species is human, are highly preferred, and are suggested to be combined with each embodiment disclosed for these aspects. Antibodies having human derived CDRs are highly preferred and are suggested to be combined with each embodiment disclosed for these aspects. According to the current aspects, antibodies having a HCDR3 domain characterized by a frequency of at least 21% tyrosine residues and/or at least 2%, 7% or 10% histidine are highly preferred and are suggested to be combined with each embodiment disclosed for the current aspect. According to the current aspects, antibodies inducing both, ADCC and ADCP, such as afucosylated antibodies, are highly preferred, and are suggested to be combined with each embodiment disclosed for these aspects. According to the current aspects, low internalizing or non-internalizing antibodies or fragments are highly preferred and are suggested to be combined with each embodiment disclosed for these aspects. Some highly preferred characterizing features which are applicable for each of the described aspects are described under section "Preferred combinations according to 'all aspects'".

Aspect 7—CCR8 Antibody Binding Sulfated TRD

The extracellular domains of human CCR8 can be structured into four regions:
(i) an N-terminal domain which can be subdivided into
  a) the membrane-distal tyrosine-rich domain (TRD), formed by amino acids 1 to 24 (SEQ ID NO:43)
  b) a cysteine at amino acid position 25, and
  c) a LID domain, formed by amino acids 26 to 35 (SEQ ID NO:49)
(iii) an extracellular domain 1 (ECL1) according to SEQ ID NO:52,
(iii) an extracellular domain 2 (ECL2) according to SEQ ID NO:55, and
(iv) an extracellular domain 3 (ECL3) according to SEQ ID NO:58.

According to a 7th aspect, which may be or may not be the same as the 6$^{th}$ aspect, there is provided an isolated antibody or antigen-binding fragment thereof, specifically binding to the sulfated tyrosine rich domain of CCR8.

For example, the antibody or antigen-binding fragment binds to a first isolated sulfated polypeptide which comprises
a) the tyrosine rich domain (TRD) of CCR8 or
b) the N term of CCR8 including the TRD,
optionally wherein at least the cysteine between the TRD and the LID domain has been removed or has been exchanged into a different amino acid. A sulfated polypeptide according to the current aspect is a polypeptide wherein preferably at least 25%, at least 50% or at least 75% of the tyrosine residues of the TRD are sulfated. Where the polypeptide comprises the N term of CCR8 including the TRD, preferably the cysteine between the TRD and the LID domain has been exchanged into a serine or has been removed. Without being bound by theory, the specific recognition of the provided sulfation pattern for CCR8 seems to influence if the antibody competes with CCL1, the natural ligand for CCR8, and also if and how the antibody agonizes or antagonizes the CCR8 signaling, e.g. as described according to the 11$^{th}$ aspect. In some preferred embodiments according to the current aspect, the inventive antibody binds sulfated TRD of human and/or cynomolgus CCR8 with a KD value of <5E-8 M, <4E-8 M, <3E-8 M, <2E-8 M, <1E-8 M, <9E-9 M, <8E-9 M, <7E-9 M, <6E-9 M, <5E-9 M, <4E-9 M, <3E-9 M, <2.5E-9 M, <2E-9 M, <1.5E-9 M, <1E-9 M, <9E-10 M, <8E-10 M, <7E-10 M, <6E-10 M, <5E-10 M, <4E-10 M, <3E-10 M, <2.5E-10 M, <2E-10 M, <1.5E-10 M, <1E-10 M, or <9E-11 M. For example, the inventive antibody may bind sulfated TRD of human and/or cynomolgus CCR8 with a KD value between <8E-9 M and >4E-10 M. For example, the inventive antibody may bind sulfated TRD of human and/or cynomolgus CCR8 with a KD value between <8E-9 M and >5.5E-10 M. In some further preferred of these embodiments, the inventive antibody binds the sulfated N term (i.e. comprising the aforementioned sulfated TRD) of human and/or cynomolgus CCR8 with substantially the same KD value. In some most preferred of these embodiments, the inventive antibody does substantially not bind non-sulfated TRD of human and/or cynomolgus CCR8.

In some preferred embodiments according to the current aspect, the inventive antibody binds sulfated N term of human and/or cynomolgus CCR8 with a KD value of <5E-8 M, <4E-8 M, <3E-8 M, <2E-8 M, <1E-8 M, <9E-9 M, <8E-9 M, <7E-9 M, <6E-9 M, <5E-9 M, <4E-9 M, <3E-9 M, <2.5E-9 M, <2E-9 M, <1.5E-9 M, <1E-9 M, <9E-10 M, <8E-10 M, <7E-10 M, <6E-10 M, <5E-10 M, <4E-10 M, <3E-10 M, <2.5E-10 M, <2E-10 M, <1.5E-10 M, <1E-10 M, <9E-11 M, <8E-11 M, <7E-11 M, <6E-11 M, or <5E-11 M. For example, the inventive antibody may bind sulfated N term of human and/or cynomolgus CCR8 with a KD value between <8E-9 M and >8E-11 M. For example, the inventive antibody may bind sulfated N term of human and/or cynomolgus CCR8 with a KD value between <8E-9 M and >7.5E-11 M. In some further preferred of these embodiments, the inventive antibody binds sulfated TRD (i.e., a subsequence of the aforementioned sulfated N term) of human and/or cynomolgus CCR8 with substantially the same KD value or a KD value within the same order of magnitude. In some most preferred of these embodiments, the inventive antibody does substantially not bind non-sulfated TRD of human and/or cynomolgus CCR8.

According to some first embodiments of the 7th aspect, the first isolated sulfated polypeptide comprises
a) SEQ ID NO:43 (CCR8 HUMAN_TRD), preferably wherein at least two or all of Y3, Y15 and Y17 have been sulfated,
b) SEQ ID NO:44 (CCR8_MACFA_TRD), preferably wherein at least two or all of Y3, Y15 and Y17 have been sulfated, and/or
c) SEQ ID NO:45 (CCR8_MOUSE_TRD), preferably wherein at least two or all of Y3, Y14 and Y15 have been sulfated.

According to some second embodiments of the 7th aspect, the first isolated sulfated polypeptide comprises
a) SEQ ID NO:46 (CCR8_HUMAN_N term with C=X or S), preferably wherein at least two or all of Y3, Y15 and Y17 have been sulfated,
b) SEQ ID NO:47 (CCR8_MACFA_N term with C=X or S), preferably wherein at least two or all of Y3, Y15 and Y17 have been sulfated, and/or
c) SEQ ID NO:48 (CCR8_MOUSE_N term with C=X or S), preferably wherein at least two or all of Y3, Y14 and Y15 have been sulfated.

According to some third embodiments of the 7th aspect, which may be the same as or different from the first and/or second embodiments, the antibody or antigen-binding fragment specifically binds to the first isolated sulfated polypeptide with a dissociation constant or an EC50 of <15 nM, <10 nM, <5 nM, <1 nM or <0.6 nM.

According to some preferred of these embodiments, the isolated antibody or antigen-binding fragment thereof, specifically binds with a dissociation constant or an EC50 of <15 nM, <10 nM, <5 nM, <1 nM or <0.6 nM
a) to human CCR8 or to an isolated polypeptide according to SEQ ID NO:46, wherein at least two or all of Y3, Y15 and Y17 have been sulfated, b) to cynomolgus CCR8 or to an isolated polypeptide according to SEQ ID NO:47, wherein at least two or all of Y3, Y15 and Y17 have been sulfated, and/or c) to murine CCR8 or to an isolated polypeptide according to SEQ ID NO:48, wherein at least two or all of Y3, Y14 and Y15 have been sulfated.

According to some fourth embodiments of the 7$^{th}$ aspect, which may be and are suggested to be combined with the first, second, and/or third embodiments of the 7$^{th}$ aspect, the dissociation constant (KD) of the antibody for binding the first isolated sulfated polypeptide is lower than the dissociation constant (KD) of the antibody for binding an isolated non-sulfated polypeptide having the same sequence as the first isolated sulfated polypeptide.

According to some embodiments A of these fourth embodiments, the dissociation constant or EC50 of the antibody for binding the isolated non-sulfated polypeptide is higher than 1 pM, 10 nM, 25 nM, 50 nM, 100 nM, 150 nM, 200 nM, 250 nM, 300 nM, 350 nM, 400 nM, 450 nM, 500 nM, 600 nM, 700 nM, 800 nM, 900 nM, 1 µM, 1.25 µM, 1.5 µM, 1.75 µM, 2 µM, 2.25 µM, 2.5 µM, 2.75 µM, or 3 µM, 5 µM or is not detectable. Preferably, the dissociation constant or EC50 of the antibody for binding the isolated non-sulfated polypeptide is higher than 100 nM, 250 nM, 500 nM, 1 µM, 2 µM or 3 µM, or is not detectable. According to some embodiments B of these fourth embodiments, which may be the same as the embodiments A of the these second embodiments, the dissociation constant or the EC50 of the antibody for binding the first isolated sulfated polypeptide is below 10 nM, 5 nM, 2.5 nM, 1 nM, 0.5 nM or 0.25 nM, and the dissociation constant or the EC50 of the antibody for binding the isolated non-sulfated polypeptide is higher than 10 nM, 25 nM, 50 nM, 100 nM, 250 nM or 500 nM, or is not detectable.

Aspect 8—CCR8 Antibody Comprising Human CDRs

According to an 8th aspect, which may be or may not be the same as the 6$^{th}$ or 7$^{th}$ aspect, there is provided an isolated antibody or antigen-binding fragment thereof, (specifically) binding to CCR8, wherein the antibody comprises human derived CDRs. Most preferably, the antibody or antigen-binding fragment thereof, (specifically) binds to the sulfated TRD of CCR8. According to some preferred embodiments, a single CDR comprises less than 1, 2, 3, 4, 5 or 6 deviations from the closest human germline. According to some highly preferred embodiments, the human derived CDRs comprise no deviations or less than 1, 2, 3, 4, 5, 6, 7, 8, 9, 10, 11, 12, 13, 14 or 15 deviations from the closest human germline. The closest human germline may be determined as known in the art, e.g. in silico using IgBLAST with data retrieved from the IMGT human germline database, as discussed elsewhere herein.

While humanization of antibodies with non-human CDRs may improve the immunogenicity, residual immunogenicity resides in the CDR regions (Harding, Fiona A., et al. "The immunogenicity of humanized and fully human antibodies: residual immunogenicity resides in the CDR regions." MAbs. Vol. 2. No. 3. Taylor & Francis, 2010.). Antibodies according to the current aspect comprising human derived CDRs and a low number of germline deviations are thus assumed to have a superior suitability as therapeutic agents.

Antibodies comprising human derived CDRs can be obtained as described herein, for example by using a human phage display library as described in examples 4 and 6. In the alternative, antibodies with human CDRs can also be produced using transgenic mice which are incapable of expressing functional endogenous immunoglobulins, but which can express human immunoglobulin genes. Furthermore, antibodies comprising human CDRs may also be generated by using in vitro activated B cells (see, U.S. Pat. Nos. 5,567,610 and 5,229,275, each of which is incorporated herein by reference in its entirety).

The provided isolated antibody or antigen-binding fragment comprising human derived CDRs is preferably also an antibody according to any of aspects 9, 10, 11, 12, 13, 14, 15, 16, 17 or 18 or a combination thereof.

Aspect 9—Cross Reactive CCR8 Antibody

According to a 9th aspect, which may be or may not be the same as the 6$^{th}$, 7$^{th}$ and/or 8$^{th}$ aspect, there is provided an isolated antibody or antigen-binding fragment thereof, specifically binding to CCR8, wherein the antibody or antigen-binding fragment is cross reactive for CCR8 from at least two species, preferably selected from human, monkey, *Macaca fascicularis* (cynomolgus monkey), *Macaca mulatta* (*Rhesus macaque*), rodent, mouse, rat, horse, bovine, pig, dog, cat and camel, even more preferably selected from human, cynomolgus and mouse. According to some most preferred embodiments, the antibody or antigen-binding fragment is cross reactive for human and cynomolgus CCR8.

In preferred embodiments, the antibody or antigen-binding fragment binds the CCR8 from a first species with a first dissociation constant KD and binds the CCR8 from a second species with a second dissociation constant KD, wherein the first and the second dissociation constant are in the same order of magnitude. As understood by the skilled person, an order-of-magnitude difference between two values is a factor of 10.

Cross reactive anti-CCR8 antibodies are advantageous for the development of a therapeutic antibody because they can be used in non-human animal models to characterize the therapeutic agents with regards to pharmacological data and safety before the antibodies are administered to humans. However, cross reactive antibodies with similar binding behavior in two species are difficult to generate, because the parts of CCR8 which can be used for antibody recognition have a low homology between species (see example 2). According to the current invention, cross reactive antibodies for CCR8 can be generated by using small sulfated tyrosine comprising motifs which have a higher conservation between species, such that cross reactive antibodies binding CCR8 from two or more species with affinities in the same order of magnitude could be obtained in an easy and convenient way. In more detail, the antibodies specifically bind sulfated TRD motifs and cross-reactive antibodies can be obtained because these sulfated TRD motifs are conserved between species.

In some preferred embodiments according to the current aspect, the inventive antibody binds sulfated TRD of human and cynomolgus CCR8 with a KD value of <5E-8 M, <4E-8 M, <3E-8 M, <2E-8 M, <1E-8 M, <9E-9 M, <8E-9 M, <7E-9 M, <6E-9 M, <5E-9 M, <4E-9 M, <3E-9 M, <2.5E-9 M, <2E-9 M, <1.5E-9 M, <1E-9 M, <9E-10 M, <8E-10 M, <7E-10 M, <6E-10 M, <5E-10 M, <4E-10 M, <3E-10 M, <2.5E-10 M, <2E-10 M, <1.5E-10 M, <1E-10 M, or <9E-11 M. For example, the inventive antibody may bind sulfated TRD of human and cynomolgus CCR8 with a KD value between <8E-9 M and >4E-10 M. For example, the inventive antibody may bind sulfated TRD of human and cynomolgus CCR8 with a KD value between <8E-9 M and >5.5E-10 M. In some further preferred of these embodiments, the inventive antibody binds the sulfated N term (i.e. comprising the aforementioned sulfated TRD) of human and cynomolgus CCR8 with substantially the same KD value or a KD within one order of magnitude. In some most preferred of these embodiments, the inventive antibody does substantially not bind non-sulfated TRD of human and cynomolgus CCR8.

In some preferred embodiments according to the current aspect, the inventive antibody binds sulfated N term of human and cynomolgus CCR8 with a KD value of <5E-8 M, <4E-8 M, <3E-8 M, <2E-8 M, <1E-8 M, <9E-9 M, <8E-9 M, <7E-9 M, <6E-9 M, <5E-9 M, <4E-9 M, <3E-9 M, <2.5E-9 M, <2E-9 M, <1.5E-9 M, <1E-9 M, <9E-10 M, <8E-10 M, <7E-10 M, <6E-10 M, <5E-10 M, <4E-10 M, <3E-10 M, <2.5E-10 M, <2E-10 M, <1.5E-10 M, <1E-10 M, <9E-11 M, <8E-11 M, <7E-11 M, <6E-11 M, or <5E-11 M. For example, the inventive antibody may bind sulfated N term of human and cynomolgus CCR8 with a KD value between <8E-9 M and >8E-11 M. For example, the inventive antibody may bind sulfated N term of human and cynomolgus CCR8 with a KD value between <8E-9 M and >7.5E-11 M. In some further preferred of these embodiments, the inventive antibody binds sulfated TRD (i.e., a subsequence of the aforementioned sulfated N term) of human and cynomolgus CCR8 with substantially the same KD value or a value in the same order of magnitude. In some most preferred of these embodiments, the inventive antibody does substantially not bind non-sulfated TRD of human and cynomolgus CCR8.

According to some first embodiments of the 9th aspect, the antibody specifically binds to
a) a first isolated sulfated polypeptide comprising SEQ ID NO:46 (CCR8_HUMAN_N term with C=X or S), preferably wherein at least two or all of Y3, Y15 and Y17 have been sulfated, and a second isolated sulfated polypeptide comprising SEQ ID NO:47 (CCR8_MACFA_N term with C=X or S), preferably wherein at least two or all of Y3, Y15 and Y17 have been sulfated, or
b) a first isolated sulfated polypeptide comprising SEQ ID NO:43 (CCR8_HUMAN_TRD), preferably wherein at least two or all of Y3, Y15 and Y17 have been sulfated, and a second isolated sulfated polypeptide comprising SEQ ID NO:44 (CCR8_MACFA_TRD), preferably wherein at least two or all of Y3, Y15 and Y17 have been sulfated.

Preferably, the EC50 of the antibody or antigen-binding fragment for binding human CCR8 or for binding the first isolated sulfated polypeptide is below 200 nM, 150 nM, 100 nM, 10 nM, 5 nM, 2.5 nM, 1 nM, 0.5 or 0.25 nM, such as below 10 nM, 5 nM, 2.5 nM, 1 nM, 0.5 or 0.25 nM. Preferably, the EC50 of the antibody or antigen-binding fragment for binding cynomolgus CCR8 or for binding the second isolated sulfated polypeptide is below 10 nM, 5 nM, 2.5 nM, 1 nM, 0.5 or 0.25 nM. In some preferred embodiments, the antibodies bind the first isolated sulfated polypeptide and the second isolated sulfated polypeptide with substantially the same affinity.

According to some second embodiments of the 9th aspect, the antibody specifically binds to
a) a first isolated sulfated polypeptide comprising SEQ ID NO:46 (CCR8_HUMAN_N term with C=X or S), preferably wherein at least two or all of Y3, Y15 and Y17 have been sulfated, and a second isolated sulfated polypeptide comprising SEQ ID NO:48 (CCR8_MOUSE_N term with C=X or S), preferably wherein at least two or all of Y3, Y14 and Y15 have been sulfated, or
b) a first isolated sulfated polypeptide comprising SEQ ID NO:43 (CCR8_HUMAN_TRD), preferably wherein at least two or all of Y3, Y15 and Y17 have been sulfated, and a second isolated sulfated polypeptide comprising SEQ ID NO:45 (CCR8_MOUSE_TRD), preferably wherein at least two or all of Y3, Y14 and Y15 have been sulfated.

Preferably, the EC50 of the antibody or antigen-binding fragment for binding human CCR8 or for binding the first isolated sulfated polypeptide is below 200 nM, 150 nM, 100 nM, 10 nM, 5 nM, 2.5 nM, 1 nM, 0.5 or 0.25 nM, such as below 10 nM, 5 nM, 2.5 nM, 1 nM, 0.5 or 0.25 nM. Preferably, the EC50 of the antibody or antigen-binding fragment for binding murine CCR8 or for binding the second isolated sulfated polypeptide is below 10 nM, 5 nM, 2.5 nM, 1 nM, 0.5 or 0.25 nM. In some preferred embodiments, the antibodies bind the first isolated sulfated polypeptide and the second isolated sulfated polypeptide with substantially the same affinity.

The provided isolated antibody or antigen-binding fragment is preferably also an antibody according to any of aspects 7, 8, 10, 11, 12, 13, 14, 15, 16, 17 or 18 or a combination thereof.

Aspect 10—CCR8 Antibody Defined by HCDR3 Structure

According to a 10th aspect, which may be or may not be the same as the $6^{th}$, $7^{th}$, $8^{th}$ and/or $9^{th}$ aspect, there is provided an isolated antibody or antigen-binding fragment thereof, specifically binding to CCR8, wherein the antibody or antigen-binding fragment is characterized by a HCDR3 region with increased histidine and/or tyrosine frequency. As understood by the skilled person, although the frequency for each amino acid is discussed separately, the respective frequencies are interrelated and are suggested to be combined, except where the skilled person immediately recognizes their incompatibility. For determination of CDR regions, the immunoglobulin amino acid residue numbering system of Kabat was used herein and shall be decisive in case of doubt.

It was surprisingly found, that the CCR8 antibodies according to the current invention were characterized by a HCDR3 having substantially higher frequencies of tyrosine residues than would be expected for a random fully human HCDR3 with matched length (~10%, cf. Zemlin, Michael, et al. "Expressed murine and human CDR-H3 intervals of equal length exhibit distinct repertoires that differ in their amino acid composition and predicted range of structures." Journal of molecular biology 334.4 (2003): 733-749.). On average, the initial set of inventive antibodies comprised ~20.6% tyrosine residues, while the optimized set of specific human CCR8 binding antibodies comprised on average 21% tyrosine residues in the HCDR3.

Furthermore, the number of positively charged amino acids and in particular the number of histidine residues was higher than expected, in particular in the optimized set of antibodies with improved therapeutic features, cf. example 9. On average, when summed up, histidine residues and tyrosine residues accounted for 31% of all amino acids in the HCDR3 of the optimized set of CCR8 binding antibodies. Interestingly, the used antigen comprising the sulfated TRD, is characterized by tyrosine residues and a particularly high number of negative charges, which was further increased by sulfation. Without being bound by theory, the inventors believe that the preference for a high tyrosine and histidine content in the CDRH3 of the inventive antibodies is caused by the particular sulfated motif of the antigen and that a high tyrosine/histidine content in the HCDR3 promotes the specific recognition of the antigen. Without being bound by theory, the inventors furthermore believe, that this specific recognition influences the characteristics of the obtained antibodies as a modulator of CCR8, e.g. as discussed in aspect 11.

In some highly preferred embodiments of the 10$^{th}$ aspect, there is provided an isolated antibody or antigen-binding fragment thereof, specifically binding to CCR8, wherein the antibody or fragment is characterized by a HCDR3 region comprising between 10 and 34% of tyrosine and/or between 2 and 20% of histidine.

The provided isolated antibody or antigen-binding fragment is preferably also an antibody according to any of aspects 7, 8, 9, 11, 12, 13, 14, 15, 16, 17 or 18 or a combination thereof.

In some first embodiments of the 10$^{th}$ aspect, the isolated antibody or antigen-binding fragment comprises a HCDR3 having
a) >0 and <35%, >8 and <34%, ≥10 and ≤34%, or >15 and <31% tyrosine (Y) residues, and/or
b) >0 and ≤16%, ≥2 and ≤20% or ≥7 and ≤20% histidine (H) residues, and
c) preferably >0 and ≤18%, ≥7 and ≤10% or ≥0 and ≤7% arginine (R) residues, and/or
d) preferably >0 and ≤25%, ≥7 and ≤16% or ≥7 and ≤13% aspartic acid (D) residues, and/or
e) preferably no lysine (K) residues, and/or
f) preferably no glutamic acid (E) residues.

In some second embodiments of the 10$^{th}$ aspect, which may be the same as or different from the first embodiments, the isolated antibody or antigen-binding fragment comprises a HCDR3 having
a) >0 and <47%, >22 and <50%, >10 and <34%, or >15 and <47% charged amino acids, and/or
b) >0 and <32%, >8 and <30%, or >10 and <37% positively charged amino acids, and/or
c) >0 and <26%, ≥7 and <16%, or >7 and <14% negatively charged amino acids.

In some third embodiments of the 10$^{th}$ aspect, which may be the same as or different from the first and/or second embodiments, the isolated antibody or antigen-binding fragment comprises a HCDR3 having >0 and ≤42%, ≥10 and ≤42% or ≥36 and ≤43% histidine and tyrosine residues in total.

Tyrosine (Y)

In some preferred embodiments the isolated antibody or antigen-binding fragment comprises a HCDR3 having 33%, 31%, 25%, 23%, 21%, 20%, 18%, 15%, 10%, 9%, 8% or 0% tyrosine. In some highly preferred embodiments, the isolated antibody or antigen-binding fragment comprises a HCDR3 having (a) >0 and <35%, (b) >8 and <34%, (c) >10 and <34%, or (d) >15 and <31% tyrosine. In some embodiments the isolated antibody or antigen-binding fragment comprises a HCDR3 having >8, >9, >10, >11, >12, >13, >14, >15, >16, >17, >18, >19, >20, >21, >22, >23, >24, >25, >26, >27, >28, >29, >30, >31, >32, >33% tyrosine residues. In some embodiments the isolated antibody or antigen-binding fragment comprises a HCDR3 having <35, <34, <33, <32, <31, <30, <29, <28, <27, <26, <25, <24, <23, <22, <21, <20, <19, <18, <17, <16, <15, <14 <13, <12, <11, <10, <9 or <8% tyrosine residues.

In some embodiments the isolated antibody or antigen-binding fragment comprises a HCDR3 having >0 and <34%, >1 and <34%, >2 and <34%, >3 and <34%, >4 and <34%, >5 and <34%, >6 and <34%, >7 and <34%, >8 and <34%, >9 and <34%, >10 and <34%, >11 and <34%, >12 and <34%, >13 and <34%, >14 and <34%, >15 and <34%, >16 and <34%, >17 and <34%, >18 and <34%, >19 and <34%, >20 and <34%, >21 and <34%, >22 and <34%, >23 and <34%, >24 and <34%, >25 and <34%, >26 and <34%, >27 and <34%, >28 and <34%, >29 and <34% or >30 and <34% tyrosine residues.

In some embodiments the isolated antibody or antigen-binding fragment comprises a HCDR3 having >0 and <36%, >0 and <35%, >0 and <34%, >0 and <33%, >0 and <32%, >0 and <31%, >0 and <30%, >0 and <29%, >0 and <28%, >0 and <27%, >0 and <26%, >0 and <25%, >0 and <24%, >0 and <23%, >0 and <22%, >0 and <21%, >0 and <20%, >0 and <19%, >0 and <18%, >0 and <17%, >0 and <16%, or >0 and <15%, >0 and <14%, >0 and <13%, >0 and <12%, >0 and <11%, >0 and <10%, >0 and <9%, >0 and <8%, >0 and <7%, >0 and <6%, >0 and <5% tyrosine residues.

Charged aa

In some preferred embodiments the isolated antibody or antigen-binding fragment comprises a HCDR3 having 47%, 39%, 31%, 28%, 27%, 25%, 23%, 20%, 18%, 17%, 16%, 15%, 9% or 0% charged amino acids. In some highly preferred embodiments, the isolated antibody or antigen-binding fragment comprises a HCDR3 having (a) >0 and <47%, (b) >22 and <50%, (c) >10 and <34%, or (d) >15 and <47% charged amino acids.

Positively Charged aa

In some preferred embodiments the isolated antibody or antigen-binding fragment comprises a HCDR3 having 31%, 23%, 18%, 15%, 10%, 8%, 7%, or 0% positively charged amino acids. In some highly preferred embodiments, the isolated antibody or antigen-binding fragment comprises a HCDR3 having (a) >0 and <32%, (b) >8 and <30%, or (c) >10 and <37% positively charged amino acids.

Negatively Charged aa

In some preferred embodiments the isolated antibody or antigen-binding fragment comprises a HCDR3 having 25%, 17%, 15%, 11%, 10%, 9%, 8%, 7%, or 0% negatively charged amino acids. In some highly preferred embodiments, the isolated antibody or antigen-binding fragment comprises a HCDR3 having (a) >0 and <26%, (b) >7 and <16%, or (c) >7 and <14% negatively charged amino acids.

Histidine (H)

In some preferred embodiments the isolated antibody or antigen-binding fragment comprises a HCDR3 having 0%, 3%, 7%, 8%, 10% or 15 histidine residues. Preferably, the isolated antibody or antigen-binding fragment comprises a HCDR3 having at least one histidine residue. In some highly preferred embodiments, the isolated antibody or antigen-binding fragment comprises a HCDR3 having (a) >0 and ≤16%, (b) ≥2 and ≤20% or (c) ≥7 and ≤20% histidine residues.

In some embodiments the isolated antibody or antigen-binding fragment comprises a HCDR3 having ≥0, >0, >1, >2, >3, >4, >5, >6, >7, >8, >9, >10, >11, >12, >13, >14, >15, >16, >17, >18, >19, >20% histidine residues. In some embodiments the isolated antibody or antigen-binding fragment comprises a HCDR3 having <20, <19, <18, <17, <16, <15, <14<13, <12, <11, <10, <9, <8, <7, <6, <5, <4, <3, <2 or <1% histidine residues.

In some embodiments the isolated antibody or antigen-binding fragment comprises a HCDR3 having >0 and <24%, >1 and <24%, >2 and <24%, >3 and <24%, >4 and <24%, >5 and <24%, >6 and <24%, >7 and <24%, >8 and <24%, >9 and <24%, >10 and <24%, >11 and <24%, >12 and <24%, >13 and <24%, >14 and <24%, >15 and <24%, >16 and <24%, >17 and <24%, >18 and <24%, >19 and <24%, >20 and <24%, >21 and <24%, >22 and <24% or >23 and <24% histidine residues.

In some embodiments the isolated antibody or antigen-binding fragment comprises a HCDR3 having >0 and <24%, >0 and <23%, >0 and <22%, >0 and <21%, >0 and <20%, >0 and <19%, >0 and <18%, >0 and <17%, >0 and <16%, or >0 and <15%, >0 and <14%, >0 and <13%, >0 and <12%, >0 and <11%, >0 and <10%, >0 and <9%, >0 and <8%, >0 and <7%, >0 and <6%, >0 and <5%, >0 and <4%, >0 and <3%, >0 and <2% or >0 and <1% histidine residues.

Histidine+Tyrosine

In some preferred embodiments the isolated antibody or antigen-binding fragment comprises a HCDR3 having 42%, 38%, 33%, 31%, 30%, 24%, 23%, 18%, 15%, 10%, 9% or 0% histidine and tyrosine residues in total. Preferably, the isolated antibody or antigen-binding fragment comprises a HCDR3 having at least one histidine residue. In some highly preferred embodiments, the isolated antibody or antigen-binding fragment comprises a HCDR3 having (a) >0 and ≤42%, (b) ≥10 and ≤42% or (c) ≥36 and ≤43% histidine and tyrosine residues in total.

Arginine (R)

In some preferred embodiments the isolated antibody or antigen-binding fragment comprises a HCDR3 having 0%, 7%, 8%, 10%, 15% or 18% arginine residues. In some highly preferred embodiments, the isolated antibody or antigen-binding fragment comprises a HCDR3 having (a) >0 and ≤18%, (b) ≥7 and ≤10% or (c) ≥0 and ≤7% arginine residues.

Lysine (K)

In some embodiments the isolated antibody or antigen-binding fragment comprises a HCDR3 having 0% to 8% lysine residues. In some embodiments, the isolated antibody or antigen-binding fragment comprises a HCDR3 having no lysine residues.

Aspartic Acid (D)

In some preferred embodiments the isolated antibody or antigen-binding fragment comprises a HCDR3 having 0%, 7%, 8%, 9%, 10%, 11%, 15%, 16%, 17% or 25% aspartic acid residues. In some highly preferred embodiments, the isolated antibody or antigen-binding fragment comprises a HCDR3 having (a) >0 and ≤25%, (b) ≥7 and ≤16% or (c) ≥7 and ≤13% aspartic acid residues.

Glutamic acid (E)

In some embodiments the isolated antibody or antigen-binding fragment comprises a HCDR3 having 0%, 8%, or 9% glutamic acid residues. In some highly preferred embodiments, the isolated antibody or antigen-binding fragment comprises a HCDR3 having no glutamic acid residues.

Length

In some embodiments the isolated antibody or antigen-binding fragment comprises a HCDR3 having a length of 3, 4, 5, 6, 7, 8, 9, 10, 11, 12, 13, 14, 15, 16, 17, 18, 19, or 20 amino acids. Preferably, the isolated antibody or antigen-binding fragment comprises a HCDR3 having a length of 10, 11, 12 or 13 amino acid residues or a length between 8 and 13 amino acid residues.

Aspect 11—Blocking/Neutral Ccr8 Antibody

There are multiple different ways how an antibody can modulate CCR8 signaling. For example, an antibody can
a) block G-protein independent signaling,
b) block G-protein dependent signaling,
c) block G-protein dependent and G-protein independent signaling,
d) increase G-protein independent signaling,
e) increase G-protein dependent signaling,
f) increase G-protein dependent and G-protein independent signaling.

According to an 11th aspect, which may be or may not be the same as the $6^{th}$, $7^{th}$, $8^{th}$, $9^{th}$ and/or $10^{th}$ aspect, there is provided an isolated antibody or antigen-binding fragment thereof, specifically binding to CCR8, wherein the antibody or antigen-binding fragment at least partially modulates CCR8 signaling. For CCR8, G-protein independent signaling pathways are β-arrestin signaling (example 10.4.1), phospho Erk1/2 signaling (phosphorylation of Erk1/2), and phospho Akt signaling (phosphorylation of AKT) (example 10.4.2). Further subtypes of antagonists or agonist can be defined based on the impact on these three G-protein independent signaling pathways.

According to some first embodiments of the $11^{th}$ aspect, the antibody or antigen-binding fragment
a) does not block CCL1 induced β-arrestin signaling and/or
b) does not induce ERK1/2 phosphorylation and/or
c) does not induce AKT phosphorylation.

Example 10.4.1 shows that the prior art antibodies 433H and L268G8 efficiently blocked CCL1 induced β-arrestin signaling, e.g. with IC50 values below 20 nM (cf. table 10.4.1.1), while no IC50 value could be determined for inventive antibodies such as TPP-23411.

According to some embodiments A of the first embodiments of the $11^{th}$ aspect, the antibody or antigen-binding fragment does not block CCL1 induced β-arrestin signaling. In case of doubt, an antibody blocks CCL1 induced β-arrestin signaling, if the IC50 is below 100 nM. In case of doubt, an antibody does not block CCL1 induced β-arrestin signaling, if the IC50 is ≥100 nM, or if no IC50 can be determined with the assay system described herein. CCL1 induced β-arrestin signaling has been linked to receptor internalization as discussed for the $12^{th}$ aspect.

Figure 27:
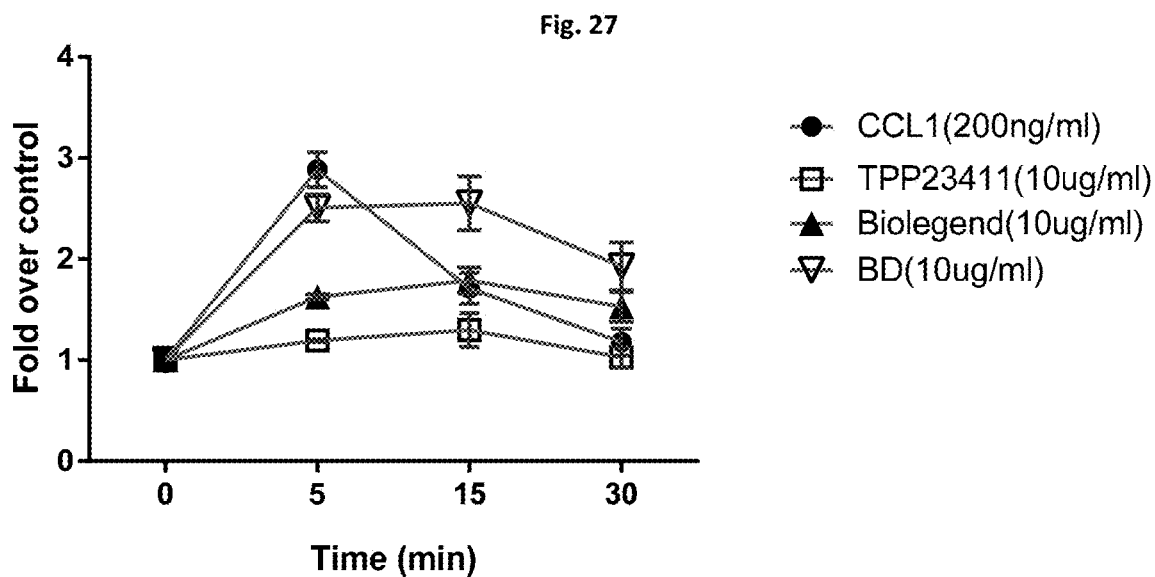
FIG. 27: Phospho Erk 1/2 ELISA assay. CHO cells expressing human CCR8 were treated with CCL1, TPP-23411, Biolegend L263G8 or BD antibody 433H and cell lysates were collected at the respective time point.
Figure 28:
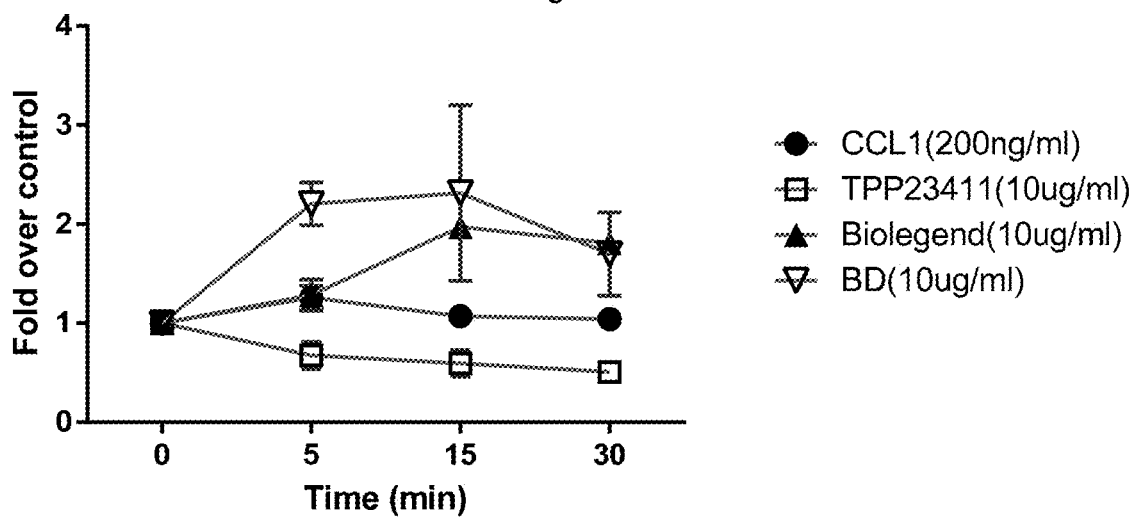
FIG. 28: Phospho Erk 1/2 ELISA assay. Activated human Treg cells expressing CCR8 were treated with CCL1, TPP-23411, Biolegend L263G8 or BD antibody 433H, and cell lysates were collected at the respective time point. Prior art antibodies Biolegend L263G8 and BD antibody 433H both induced a significant increase of phosphorylated Erk1/2 levels, e.g. after 15 minutes in activated human Tregs, while this was not the case for inventive antibody.

Example 10.4.2, FIG. 27, 28 show that prior art antibodies induce phosphorylation of Erk1/2 in CHO cells expressing human CCR8 or human activated Tregs, e.g. after 15 minutes, at least by a factor of 1.5. Instead, the inventive antibody TPP-23411 did not induce a significant phosphorylation of Erk1/2.

According to some embodiments B of the first embodiments of the $11^{th}$ aspect, the antibody or antigen-binding fragment does not induce ERK1/2 phosphorylation. In case of doubt, an antibody induces phosphorylation of Erk1/2, if—using an assay as described herein—at least a 1.5-fold increase of Erk1/2 phosphorylation levels over control can be detected. In case of doubt, an antibody does not induce phosphorylation of Erk1/2, if no significant increase of Erk1/2 phosphorylation levels is detected or if the increase is below 1.5-fold over control.

Figure 30:
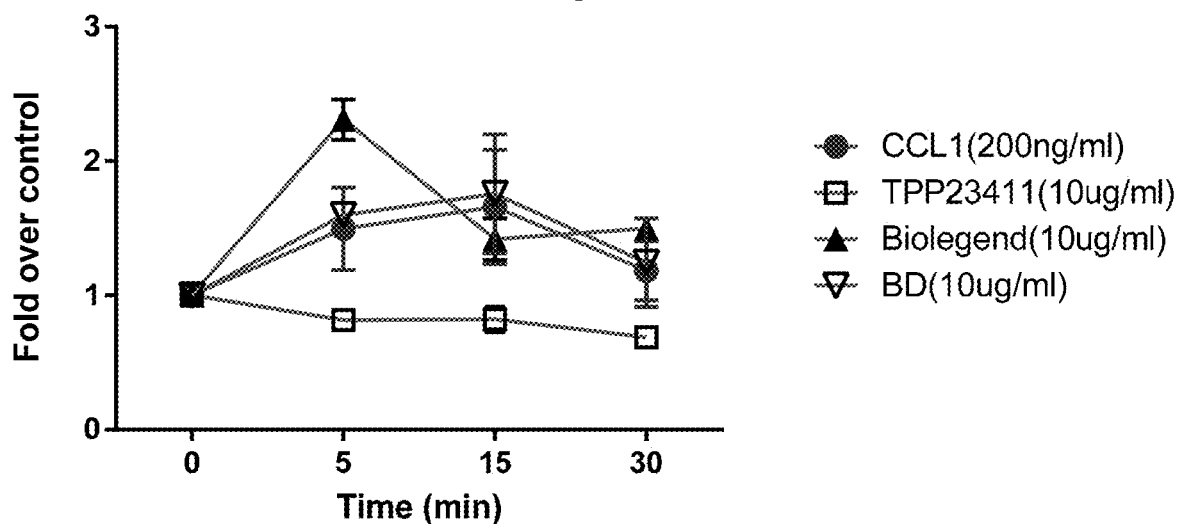
FIG. 30: Phospho AKT ELISA assay. Activated human Treg cells expressing CCR8 were treated with CCL1, TPP-23411, Biolegend L263G8 or BD antibody 433H, and cell lysates were collected at the respective time point. Prior art antibodies Biolegend L263G8 and BD 433H both induced a significant increase of phospho AKT levels in activated human Tregs, e.g. after 15 minutes, while this was not the case for inventive antibodies.

Example 10.4.2, FIG. 30, show that prior art antibodies induce phosphorylation of AKT, e.g. after 15 minutes at least by a factor of 1.5. Instead, the inventive antibody TPP-23411 did not induce a significant phosphorylation of AKT.

According to some embodiments C of the first embodiments of the $11^{th}$ aspect, the antibody or antigen-binding fragment does not induce AKT phosphorylation. In case of doubt, an antibody induces phosphorylation of AKT, if—using an assay as described herein—at least a 1.5-fold increase of AKT phosphorylation levels over control can be detected. In case of doubt, an antibody does not induce phosphorylation of AKT, if no significant increase of AKT phosphorylation levels is detected or if the increase is below 1.5-fold over control.

Antibodies or fragments which show no induction of G-protein independent signaling pathways such as AKT or ERK1/2 phosphorylation are assumed to have advantages in therapy because induction of G-protein dependent signaling may lead to unwanted effects and side effects.

To analyze G-protein dependent signaling, the Ca flux assay as known in the art and as described herein can be used as a read out. The majority of tested inventive antibodies were found to be fully efficacious antagonists of G protein dependent Ca signaling, however, differences in the IC50 could be determined in comparison with the prior art antibodies.

Example 10.4.3 shows that several of the tested anti-CCR8 antibodies blocked CCL1 induced G protein dependent Ca signaling, e.g. with IC50 values in the low nM or even sub nM range.

According to some second embodiments of the $11^{th}$ aspect, which can be the same as or different from the first embodiments, the antibody or antigen-binding fragment blocks CCL1 induced calcium signaling. In some preferred of these embodiments, the antibody or antigen binding fragment blocks CCL1 induced calcium signaling, e.g. with an IC50<1 nM, <0.5 nM or <0.01 nM.

According to some third embodiments of the $11^{th}$ aspect, which can be the same as or different from the first embodiments, the antibody or antigen-binding fragment does not block CCL1 induced G protein dependent calcium signaling.

Aspect 12—None and/or Low Internalizing CCR8 Antibody

An anti-CCR8 antibody can be a non-internalizing, low internalizing, medium internalizing or high internalizing antibody or antigen-binding fragment.

According to a 12th aspect, which may be or may not be the same as the $6^{th}$, $7^{th}$, $8^{th}$, $9^{th}$, $10^{th}$ and/or $11^{th}$ aspect, there is provided an isolated antibody or antigen-binding fragment thereof, specifically binding to CCR8, wherein the antibody or antigen-binding fragment is a non-internalizing or low internalizing antibody or antigen binding fragment.

Depending on the specific mode of action of an antibody, fragment or conjugate, internalization into a cell may be desired or has to be avoided, as discussed elsewhere herein. The antibodies according to the 12th aspect are particularly suited for an ADCC/ADCP approach, or any other mode of action relying on the antibody or antigen binding fragment for recruiting effector cells.

Because overexpression may impact the internalization behavior and is less suited to model internalization in a therapeutic setting, internalization is preferably determined using a model cell line with endogenous expression of the target. Where the target is human CCR8, the cell endogenously expressing the target is preferably HuT78. Where the target is murine CCR8, the cell endogenously expressing the target is preferably murine BW5147.3. HuT78 and mBW5147.3 can be obtained from ATCC.

While all prior art antibodies readily internalized into cells with endogenous target expression, as shown in example 10.5, the tested antibodies TPP-21360, TPP-21047 (data not shown) and TPP-23411 and various further antibodies according to the current invention did not significantly internalize. For example, internalization can be determined over a time frame or for specific time points. Preferably internalization can be determined after 15 min, 30 min, 1 h, 2 h, 3 h, 6 h, 12 h, 24 h or 48 h in a cell endogenously expressing the target.

According to some first embodiments of the $12^{th}$ aspect, the antibody or antigen-binding fragment is characterized by an internalization into a cell with endogenous target expression which is lower than the 1.5, 2, 3, 4, 5, 6, 7, or 10-fold of the internalization of the isotype control. The isotype control for an antibody can be selected as known in the art to match the isotype of the antibody as closely as possible, but without binding the target.

According to some of these embodiments, the antibody or antigen-binding fragment is characterized by an internalization into a cell with endogenous target expression which is lower than 150%, 175%, 200%, 300%, 400% or 500% of the internalization of the isotype control e.g. after 15 min, 30 min, 1 h, 2h, 3 h, 6 h, 12 h, 24 h or 48 h, preferably wherein the cell with endogenous target expression is a HuT78 lymphoma cell.

According to some preferred of these embodiments, the antibody or antigen-binding fragment has an internalization rate in the same order of magnitude as the internalization rate of the isotype control.

According to some second embodiments of the $12^{th}$ aspect, which may be the same as or different from the first embodiments, the antibody or antigen-binding fragment specifically binds human CCR8 and is characterized by a time until half of the amount of antibody, fragment or conjugate has been internalized which is >2 hours, preferably >4, >5, >6, >7, >8, >9, >10, >11, >12, >13, >14, >15, >16, >17, >18, >19, >20, >21, >22, >23, >24, >26, >28, >30, or >48 hours in a cell endogenously expressing the target, or no such time can be determined at all, preferably wherein the cell endogenously expressing the target is a HuT78 lymphoma cell. For example, the anti-CCR8 antibody has a lower internalization rate than antibodies 433H and L263G8 (BioLegend Cat. No. 360602).

According to some third embodiments of the $12^{th}$ aspect, which may be the same as or different from the first or second embodiments, the antibody or antigen-binding fragment specifically binds murine CCR8 and has a lower internalization rate than antibody SA214G2 in a cell endogenously expressing the target, preferably wherein the cell endogenously expressing the target is a murine lymphoma cell line BW5147.3.

The provided isolated antibody or antigen-binding fragment is preferably also an antibody according to any of aspects 7, 8, 9, 10, 11, 13, 14, 15, 16, 17 or 18 or a combination thereof.

Aspect 13—ADCC/ADCP Inducing CCR8 Antibody

To induce the killing of CCR8 expressing cells such as activated Tregs, multiple modes of action can be envisioned. One mode of action is the conjugation of an antibody targeting CCR8 to a drug in the form of an antibody drug conjugate (ADC). Other possible modes of action are ADCC, CDC and ADCP. For ADCC, CDC and ADCP, a two-step mechanism is involved: On the one hand, the antibody or fragment is required to effectively bind the target cell, e.g. the Treg via CCR8, on the other hand, the FC part of the antibody (or an alternative binding moiety which can be conjugated to the antibody or fragment as described elsewhere herein) has to bind to an effector cell, which will then mediate the killing of the target cell. For ADCP, binding to macrophages as effector cells typically occurs via the interaction of the antibodies FC part with FcγRIIa (CD32a) expressed by macrophages. In contrast, ADCC is mediated via interaction of the antibody or fragment with FcγRIIIa. In humans, FcγRIII exists in two different forms: FcγRIIIa (CD16a) and FcγRIIIb (CD16b). While FcγRIIIa is expressed on mast cells, macrophages, and natural killer cells as a transmembrane receptor, FcγRIIIb is only expressed on neutrophils. These receptors bind to the Fc portion of IgG antibodies, which then activates antibody-dependent cell-mediated cytotoxicity (ADCC) mediated by the human effector cells.

In case of doubt, where ADCC and/or ADCP induction is analyzed, at least 80% and preferably at least 85% of the target cells are required to show CCR8 expression.

According to a 13th aspect, which may be or may not be the same as the $6^{th}$, $7^{th}$, $8^{th}$, $9^{th}$, $10^{th}$, $11^{th}$ and/or $12^{th}$ aspect, there is provided an isolated antibody or antigen-binding fragment thereof, specifically binding to CCR8, wherein the antibody or antigen-binding fragment induces ADCC and/or ADCP.

For example, there is provided an isolated antibody or antigen-binding fragment thereof specifically binding to CCR8, wherein the antibody or antigen-binding fragment is afucosylated and a) induces antibody-dependent cell-mediated cytotoxicity (ADCC) in target cells expressing human CCR8 via human effector cells, such as human NK cells, and b) induces antibody-dependent cell-mediated phagocytosis (ADCP) in target cells expressing human CCR8 via human effector cells, such as human macrophages, preferably wherein the maximal ADCC and ADCP induced in vitro depletion of target cells expressing human CCR8 is at least 30%, 35%, 40%, 45%, 50%, 55%, 60%, 70%, 80%, 90%, 95% or 99%. In case of doubt, ADCC and ADCP shall be determined using target cells where at least 85% of the cells express CCR8.

In some preferred embodiments of the 13th aspect, the antibody or antigen-binding fragment is afucosylated. Afucosylated antibodies are antibodies engineered such that the oligosaccharides in the Fc region of the antibody do not have any fucose sugar units. Afucosylated antibodies can be obtained as known in the art, e.g. as described in example 10.3. Example 10.3.2 demonstrates the improved binding of the afucosylated versions of the inventive antibodies to FcγRIIIa. The binding to FcγRIIa was likewise slightly improved. Afucosylation furthermore increased the binding to cynomolgus Fc gamma RIII, cf. Table 10.3.2.1.

ADCC

In some first embodiments A of the 13th aspect, the antibody or antigen-binding fragment binds to human Fc gamma receptor IIIA variant V176 (CD16a) with a dissociation constant (KD) lower than 530 nM, 500 nM, 450 nM, 400 nM, 300 nM or 200 nM.

In some first embodiments B of the 13th aspect, which may be the same as or different from the first embodiments A, the antibody or antigen-binding fragment induces antibody-dependent cell-mediated cytotoxicity (ADCC) in target cells expressing human CCR8 via human effector cells, such as human NK cells. ADCC induction can be analyzed with an assay known in the art, for example as described according to examples 10.3.3 ff.

In some first embodiments C of the 13th aspect, which may be the same as or different from the first embodiments A or B, the ADCC-induced maximal depletion of activated human regulatory T cells is at least 25%, 30%, 35%, 40%, 45%, 50%, 55%, 60%, 70%, 80%, 90%, 95%, 98% or 99%, preferably, where at least 85% of the activated human regulatory T cells have CCR8 expression, cf. Table 10.3.3.1.2 and Table 10.3.3.1.3.

In some first embodiments D of the 13th aspect, which may be the same as or different from the first embodiments A, B or C, the EC50 for ADCC-induced depletion of activated human regulatory T cells is below 500 pM, 400 pM, 300 pM, 200 pM, 100 pM, 50 pM, 25 pM, 20 pM, 12.5 pM, 10 pM, 5 pM or 2.5 pM. Preferably, at least 85% of the activated human regulatory T cells have CCR8 expression.

ADCP

In some second embodiments A of the 13th aspect, which may or may not be the same as the first embodiments A, B, C and/or D, the antibody or antigen-binding fragment binds to human Fc gamma RITA (CD32a) with a dissociation constant (KD) lower than 30 µM, 20 µM, 10 µM, 5 µM or 1 µM.

In some second embodiments B of the 13th aspect, which may be the same as the first embodiments A, B, C and/or D, and which may be the same as the second embodiments A, the antibody or antigen-binding fragment induces antibody-dependent cell-mediated phagocytosis (ADCP) in target cells expressing human CCR8 via human effector cells, such as human macrophages. For example, the human macrophages can be M2c or M1 macrophages.

In some second embodiments C of the 13th aspect, which may be the same as the first embodiments A, B, C and/or D, and which may the same as the second embodiments A and/or B, the ADCP-induced maximal depletion of activated human regulatory T cells is at least 5%, 10%, 15%, 20%, 25%, 30%, 40% or 50%.

In some second embodiments D of the 13th aspect, which may the same as the first embodiments A, B, C and/or D, and which may the same as the second embodiments A, B and/or C, the EC50 for ADCP-induced depletion of activated human regulatory T cells is below 1500 pM, 1000 pM, 500 pM, 250 pM, 200 pM, 150 pM, 100 pM, 75 pM, 50 pM, 25 pM or 10 pM.

In some preferred embodiments there is provided an isolated antibody or antigen-binding fragment thereof, specifically binding to CCR8, wherein the antibody or antigen-binding fragment
a) binds to human Fc gamma receptor IIIA variant V176 (CD16a) with a dissociation constant (KD) lower than 530 nM, 500 nM, 450 nM, 400 nM, 300 nM or 200 nM, and/or
b) binds to human Fc gamma RITA (CD32a) with a dissociation constant (KD) lower than 30 pM, 20 pM, 10 pM, 5 pM or 1 pM.

In some preferred embodiments there is provided an isolated antibody or antigen-binding fragment thereof, specifically binding to CCR8, wherein the antibody or antigen-binding fragment
a) induces antibody-dependent cell-mediated cytotoxicity (ADCC) in target cells expressing human CCR8 via human effector cells, such as human NK cells, and/or
b) induces antibody-dependent cell-mediated phagocytosis (ADCP) in target cells expressing human CCR8 via human effector cells, such as human macrophages.

In some preferred embodiments there is provided an isolated antibody or antigen-binding fragment thereof, specifically binding to CCR8, wherein
a) the ADCC-induced maximal depletion of activated human regulatory T cells is at least 30%, 40%, 50%, 60%, 70%, 80%, 90%, 95%, 98% or 99%, and/or
b) the ADCP-induced maximal depletion of activated human regulatory T cells is at least 5%, 10%, 15%, 20%, 25%, 30%, 40% or 50%, and/or
c) the maximal depletion of intra-tumoral regulatory T cells, in vitro or in a subject, is at least 50%, 60%, 70%, 80%, 90%, 95% or 99%.

In some preferred embodiments there is provided an isolated antibody or antigen-binding fragment thereof, specifically binding to CCR8, wherein
a) the EC50 for ADCC-induced depletion of activated human regulatory T cells is below 200 pM, 100 pM, 50 pM, 25 pM, 12.5 pM, 10 pM or 5 pM and/or
b) the EC50 for ADCP-induced depletion of activated human regulatory T cells is below 500 pM, 250 pM, 200 pM, 150 pM, 100 pM, 75 pM, 50 pM or 25 pM.

The provided isolated antibody or antigen-binding fragment is preferably also an antibody according to any of aspects 14, 15, 16, 17 or 18 or a combination thereof.

Aspect 14—Treg Modulatory Ccr8 Antibody

The therapeutic in vivo effects of the antibodies according to the current invention are shown in examples 12 ff. The ability of an antibody to modulate absolute and relative numbers of several immune cell populations is structurally realized by a combination of target binding properties and FC receptor interaction, e.g. as described according to the $7^{th}$, $10^{th}$, $12^{th}$ and/or $13^{th}$ aspect or a combination thereof. According to a 14th aspect, which may be or may not be the same as the $6^{th}$, $7^{th}$, $8^{th}$, $9^{th}$, $10^{th}$, $11^{th}$, $12^{th}$, and/or $13^{th}$ aspect, there is provided an isolated antibody or antigen-binding fragment thereof, specifically binding to CCR8, wherein the antibody or antigen-binding fragment depletes activated regulatory T cells, preferably intra-tumoral Tregs. Example 12.1.1 shows high levels of T reg depletion obtained with the inventive antibodies in various mouse models, wherein the surrogate antibodies are characterized by comparable functional features as the provided anti-human CCR8 antibodies. Interestingly, a superior therapeutic response was observed in those cases, where the Treg depletion was at least 50%. Treg depletion may be measured in vitro or in vivo. As understood by the skilled person, the Treg depletion may be a temporal depletion. For example, Treg depletion may be analyzed 24, 48 or 72 hours after treatment.

According to some first embodiments of the 14th aspect, an effective dose of the antibody or antigen-binding fragment is characterized by a maximal depletion of activated or intra-tumoral regulatory T cells, in vitro or in a subject, of at least 45%, 50%, 55%, 60%, 70%, 80%, 90%, 95% or 99%. Determination in vitro or in vivo may occur as known in the art. Determination in vivo may occur as described in examples 12 ff. Suitable subjects include for example human and non-human, such as mouse (e.g. CT26 model or EMT-6 model), rodent, or cynomolgus.

According to some second embodiments of the 14th aspect, which may or may not be the same as the first embodiments, an effective dose of the antibody or antigen-binding fragment decreases the number of activated or intra-tumoral regulatory T cells, in vitro or in a subject, to less than 55%, 50%, 40%, 30%, 25%, 20%, 10%, 5% or 1%. The decrease may be a temporary decrease. For example, and without being bound by theory, the pool of intra-tumoral Tregs may be subsequently replenished.

According to some third embodiments of the 14th aspect, which may or may not be the same as the first and/or second embodiments, an effective dose of the antibody or antigen-binding fragment increases the ratio of intra-tumoral CD8+ T cells to intra-tumoral Tregs, in vitro or in a subject, to at least 5, 10, 15, 20, 25, 30, 40, 50, 60, 70, 80, 90, 100, 150, 200, or higher. The increase may be a temporary increase.

According to some fourth embodiments of the 14th aspect, which may or may not be the same as the first, second and/or third embodiments, an effective dose of the antibody or antigen-binding fragment decreases the percentage of regulatory T cells of intra-tumoral CD4+ T cells, in vitro or in a subject, to <30%, <20%, <10% or <5%. The decrease may be a temporary decrease.

In preferred embodiments, an effective dose of the antibody or antigen-binding fragment
a) decreases the number of activated or intra-tumoral regulatory T cells, in vitro or in a subject, to less than 30%, 25%, 20%, 10%, 5% or 1% and/or
b) increases the ratio of intra-tumoral CD8+ T cells to intra-tumoral Tregs, in vitro or in a subject, to at least 5, 10, 15, 20, 25, 30, 40, 50, 60, 70, 80, 90, 100, 150, 200, or higher and/or
c) decreases the percentage of regulatory T cells of intra-tumoral CD4+ T cells, in vitro or in a subject, to <30%, <20%, <10% or <5%.

Antibodies according to the current aspect were superior in terms of therapeutic efficacy, see examples 12 ff. The provided isolated antibody or antigen-binding fragment is preferably also an antibody according to any of aspects 15, 16, 17 or 18 or a combination thereof.

Aspect 15—Immune Cell Modulatory Ccr8 Antibody

According to a 15th aspect, which may be or may not be the same as the $6^{th}$, $7^{th}$, $8^{th}$, $9^{th}$, $10^{th}$, $11^{th}$, $12^{th}$, $13^{th}$ and/or $14^{th}$ aspect, there is provided an isolated antibody or antigen-binding fragment thereof, specifically binding to CCR8, wherein an effective dose of the antibody or antigen-binding fragment increases the absolute numbers of immune cells in a defined tumor volume, e.g. at least by a factor of 1.5, 2, 2.5, 3, 3.5 or 4.

Example 12.8 shows a massive increase in the mRNA expression levels for various global or specific immune cell markers in responsive tumors from different subjects at the study end. An increase was observed e.g. for macrophages (in particular M1 macrophages), CD8+ T cells, NK cells, CD3+ T cells, B cells, and interestingly also activated Tregs, suggesting an increased infiltration of these immune cell populations within the tumor after chronic treatment. The increase in absolute immune cell numbers was also confirmed by FACS, see example 12.3 (CT26), example 12.4 (EMT6), example 12.5 (F9). Suitable subjects include for example human and non-human subjects, such as mouse, rodent, or cynomolgus. For example, the increase of immune cells can be determined after one, two, three or four effective doses of the antibody, cf. example 12.3, 12.4.2 and also after chronic treatment, e.g. after the final treatment. For example, the tumor may be a tumor characterized by tumor infiltrating lymphocytes, e.g. a tumor characterized by tumor infiltrating T cells or a tumor characterized by expression of proinflammatory cytokines.

According to some first embodiments of the 15th aspect, the immune cells are at least one, two, three, four, five, six, seven, eight or nine selected from
a) (intra-tumoral) CD45+ cells,
b) (intra-tumoral) CD8+ T cells,
c) (intra-tumoral) CD4+ T cells,
d) (intra-tumoral) macrophages, such as M1 macrophages or M2 macrophages,
e) (intra-tumoral) NK cells,
f) (intra-tumoral) B cells,
g) (intra-tumoral) Dendritic cells,
h) (intra-tumoral) Gamma delta T cells (unconventional T cells), and
i) iNKT cells.

The respective cell types and populations are defined as known in the art, and in particular as defined elsewhere herein.

According to some highly preferred of these first embodiments, three or more effective doses of the antibody or antigen-binding fragment, in a tumor, increase
a) the number of intra-tumoral CD8+ T cells to at least 150%, 200%, 250%, 300% or 350%,
b) the ratio of intra-tumoral CD8+ T cells to intra-tumoral regulatory T cells to at least 4, 5, 10, 15, 20, 25, 30, 40, 50, 60, 70, 80, 90, 100, 150, 200, or higher,
c) the number of intra-tumoral macrophages at least by a factor of 2, 3, 4, or 5,
d) the number of intra-tumoral ACOD1+ macrophages (M1 macrophages) at least by a factor of 2, 3, 4, 5, 6, 7, 8, 9 or 10,
e) the ratio of ACOD1+ macrophages (M1 macrophages) to MRC1+ macrophages (M2 macrophages) to at least 1.5, 2, 3, 4, 5, 10, or higher,
f) the number of intra-tumoral NK cells to at least 140% or 200%,
g) the number of intra-tumoral CD3+ T cells to at least 150%, 200%, 300% or 400%,
h) the number of intra-tumoral B cells at least by a factor of 2, 5, 10, 20, 30 or 40,
i) the number of intra-tumoral CD45+ T cells to at least 150%, 200% or 300%, and/or
j) the number of intra-tumoral CD4+ T cells to at least 150%, 200%, 300% or 400%.

The tumor is preferably a tumor characterized by tumor infiltrating lymphocytes. As understood by the skilled person, the tumor is characterized by cells expressing the target CCR8 of the inventive antibody or fragment, e.g. intratumoral Tregs. Preferably, the tumor is a tumor in a syngeneic tumor model derived from a BALB/c strain. For example, as shown in example 12.1.1, the tumor can be derived from the CT26 model, EMT-6 model, F9 model, C38, H22 or B16F10-OVA model, where the antibody specifically binds to murine CCR8. For example, where the antibody specifically binds to human CCR8, the tumor can be selected from Adrenal cancer (e.g. Adrenocortical carcinoma or Pheochromocytoma), Bladder cancer (e.g. Transitional cell carcinoma, Transitional cell carcinoma-Papillary), Brain cancer (e.g. Glioma-Astrocytoma, Glioma-Astrocytoma-Glioblastoma, Glioma-Oligoastrocytoma, Glioma-Oligodendroglioma), Breast cancer (e.g. ADC, ADC-Ductal, ADC-Ductal-TNBC, ADC-Ductal-TPBC, ADC-Lobular), Colorectal cancer (e.g. ADC), Esophageal cancer (e.g. ADC), Esophageal cancer (e.g. SCC), Gastric cancer (e.g. ADC, ADC-Diffuse, ADC-Intestinal, ADC-Intestinal-Tubular), Head and Neck cancer (e.g. Laryngeal cancer-SCC, SCC, Oral cancer-SCC), Kidney cancer (e.g. ccRCC, Chromophobe, Papillary, Papillary-Type I, Papillary-Type II), Liver cancer (e.g. HCC), Lung cancer (e.g. NSCLC-ADC, NSCLC-ADC-Mixed, NSCLC-SCC, SCLC), Mesothelioma (e.g. Epithelioid), Ovarian cancer (e.g. ADC-Cystadenocarcinoma-Papillary serous), Pancreatic cancer (e.g. ADC-Ductal), Prostate cancer (e.g. ADC-Acinar type), Sarcoma (e.g. Leiomyosarcoma, Liposarcoma-Dedifferentiated, Malignant fibrous histiocytoma), Skin cancer (e.g. Melanoma), Testicular cancer (e.g. Germ cell tumor-Seminoma), Thymoma, Thyroid cancer (e.g. Follicular carcinoma, Papillary carcinoma-Classical variant), Uterine cancer (e.g. Cervical-SCC, Cervical-SCC-Keratinizing, Cervical-SCC-Non-keratinizing, Endometrial-ADC-Endometrioid, Endometrial-ADC-Papillary serous, Endometrial-Carcinosarcoma-Malignant mixed mullerian tumor), cf. Table 11.1.2.

In some of these embodiments, the immune cells are
a) CD8+ T cells, CD4+ T cells, and macrophages,
b) CD8+ T cells, CD4+ T cells, NK cells,
c) CD8+ T cells, CD4+ T cells, CD45+ cells,
d) CD8+ T cells, CD4+ T cells, NK cells and macrophages,
e) CD8+ T cells, CD4+ T cells, NK cells, and macrophages, e.g. ACOD1+ macrophages,
f) CD8+ T cells, CD4+ T cells, NK cells, CD45+ cells,
g) CD8+ T cells, CD4+ T cells, NK cells, CD45+ cells, and macrophages, e.g. ACOD1+ macrophages,
h) CD8+ T cells, ACOD1+ macrophages (M1 macrophages), and B cells,
i) CD8+ T cells, CD4+ T cells, and dendritic cells, wherein the dendritic cells are characterized by expression of CD1c, CD14, CD16, CD141, CD11c and CD123, or
j) CD8+ T cells and Acod1+ macrophages (M1 macrophages).

In some preferred of these embodiments, the immune cells are
a) CD8+ T cells, CD4+ T cells, and macrophages, or
b) CD8+ T cells, CD4+ T cells, NK cells and macrophages, or
c) CD8+ T cells, ACOD1+ macrophages (M1 macrophages), and B cells.

According to some further embodiments, the immune cells are CD45+ cells and CD8+ T cells, CD45+ cells and CD4+ T cells, CD45+ cells and macrophages (such as M1 macrophages or M2 macrophages), CD45+ cells and NK cells, CD45+ cells and B cells, CD45+ cells and Dendritic cells, CD45+ cells and Gamma delta T cells, CD45+ cells and iNKT cells, CD8+ T cells and CD4+ T cells, CD8+ T cells and macrophages (such as M1 macrophages or M2 macrophages), CD8+ T cells and NK cells, CD8+ T cells and B cells, CD8+ T cells and Dendritic cells, CD8+ T cells and Gamma delta T cells, CD8+ T cells and iNKT cells, CD4+ T cells and macrophages (such as M1 macrophages or M2 macrophages), CD4+ T cells and NK cells, CD4+ T cells and B cells, CD4+ T cells and Dendritic cells, CD4+ T cells and Gamma delta T cells, CD4+ T cells and iNKT cells, macrophages (such as M1 macrophages or M2 macrophages) and NK cells, macrophages (such as M1 macrophages or M2 macrophages) and B cells, macrophages (such as M1 macrophages or M2 macrophages) and Dendritic cells, macrophages (such as M1 macrophages or M2 macrophages) and Gamma delta T cells, macrophages (such as M1 macrophages or M2 macrophages) and iNKT cells, B cells and Dendritic cells, B cells and Gamma delta T cells, B cells and iNKT cells, Dendritic cells and Gamma delta T cells, Dendritic cells and iNKT cells, or Gamma delta T cells and iNKT cells.

The provided isolated antibody or antigen-binding fragment is preferably also an antibody according to any of aspects 16, 17 or 18 or a combination thereof.

Aspect 16—CCR8 Antibody Forming Tertiary Lymphoid Structures

According to a 16th aspect, which may be or may not be the same as the $6^{th}$, $7^{th}$, $8^{th}$, $9^{th}$, $10^{th}$, $11^{th}$, $12^{th}$, $13^{th}$, $14^{th}$ and/or $15^{th}$ aspect, there is provided an isolated antibody or antigen-binding fragment thereof, specifically binding to CCR8, wherein the antibody or antigen-binding fragment induces the formation of tertiary lymphoid structures. Tertiary lymphoid structures are intra-tumoral structures characterized by increased expression of LTta, LTtb, Cxcr5 and its ligand Cxcl13. Tertiary lymphoid structures have been described as key drivers of an anti-tumor effect in humans. Without being bound by theory, the inventors believe, that the formation of these substructures might contribute to the altered pattern in immune cells and an anti-tumor effect of the inventive antibodies, e.g. in humans. As discussed in example 12.8, chronic treatment with the inventive antibodies consistently increased the expression levels for LTta, LTtb as well as Cxcr5 and its ligand Cxcl13.

SEQ Defined Antibodies

The antibodies according to the following two aspects 17 and 18 were obtained with a method according to aspect 3 or 4. The resulting antibodies according to aspect 17 and 18 specifically bind to a polypeptide comprising the sulfated TRD of a human chemokine receptor, e.g. wherein at least 50% of the tyrosine residues have been sulfated. As discussed previously herein, the method influences the specific structural features of the HCDR3 of the obtained antibodies and may also influence functional features, such as the modulation of G protein independent signaling or internalization behavior.

Where CDRs, variable heavy chains, variable light chains, heavy chains or light chains are disclosed, the modular nature of the antibodies typically allows their combination, but also the combination with the various functional features, as described elsewhere herein.

Aspect 17—Anti-Human Ccr8 Antibody (SEQ Defined)

According to a $17^{th}$ aspect, which may be or may not be the same as the 6th, 7th, 8th, 9th, 10th, 11th, 12th, 13th, $14^{th}$, $15^{th}$ and/or $16^{th}$ aspect, there is provided an isolated anti-CCR8 antibody or antigen-binding fragment thereof.

Preferably the antibodies according to the current aspect bind (a) to an isolated polypeptide according to SEQ ID NO:43 and/or SEQ ID NO:46, wherein at least two or all of Y3, Y15 and Y17 have been sulfated, and (b) to an isolated polypeptide according to SEQ ID NO:44 and/or SEQ ID NO:47, wherein at least two or all of Y3, Y15 and Y17 have been sulfated, and the antibodies are thus cross reactive for human and cynomolgus CCR8. Furthermore, the antibodies are preferably characterized by properties making them particularly suitable for therapy, e.g. are antibodies according to at least one or more of aspects 7, 8, 9, 10, 11, 12, 13, 14, 15 or 16.

According to some preferred embodiments, the isolated anti-CCR8 antibody or antigen-binding fragment thereof comprises at least one, two, and preferably three, four, five or six CDR sequence(s) having at least 90%, 95%, 98% or 100% sequence identity with any of a) SEQ ID NO:258, SEQ ID NO:259, SEQ ID NO:260, SEQ ID NO:262, SEQ ID NO:263 or SEQ ID NO:264 (TPP-16966), b) SEQ ID NO:276, SEQ ID NO:277, SEQ ID NO:278, SEQ ID NO:280, SEQ ID NO:281 or SEQ ID NO:282 (TPP-17575), c) SEQ ID NO:294, SEQ ID NO:295, SEQ ID NO:296, SEQ ID NO:298, SEQ ID NO:299 or SEQ ID NO:300 (TPP-17576), d) SEQ ID NO:312, SEQ ID NO:313, SEQ ID NO:314, SEQ ID NO:316, SEQ ID NO:317 or SEQ ID NO:318 (TPP-17577), e) SEQ ID NO:330, SEQ ID NO:331, SEQ ID NO:332, SEQ ID NO:334, SEQ ID NO:335 or SEQ ID NO:336 (TPP-17578), f) SEQ ID NO:348, SEQ ID NO:349, SEQ ID NO:350, SEQ ID NO:352, SEQ ID NO:353 or SEQ ID NO:354 (TPP-17579), g) SEQ ID NO:366, SEQ ID NO:367, SEQ ID NO:368, SEQ ID NO:370, SEQ ID NO:371 or SEQ ID NO:372 (TPP-17580), h) SEQ ID NO:384, SEQ ID NO:385, SEQ ID NO:386, SEQ ID NO:388, SEQ ID NO:389 or SEQ ID NO:390 (TPP-17581), i) SEQ ID NO:402, SEQ ID NO:403, SEQ ID NO:404, SEQ ID NO:406, SEQ ID NO:407 or SEQ ID NO:408 (TPP-18205), j) SEQ ID NO:420, SEQ ID NO:421, SEQ ID NO:422, SEQ ID NO:424, SEQ ID NO:425 or SEQ ID NO:426 (TPP-18206), k) SEQ ID NO:438, SEQ ID NO:439, SEQ ID NO:440, SEQ ID NO:442, SEQ ID NO:443 or SEQ ID NO:444 (TPP-18207), l) SEQ ID NO:456, SEQ ID NO:457, SEQ ID NO:458, SEQ ID NO:460, SEQ ID NO:461 or SEQ ID NO:462 (TPP-19546), m) SEQ ID NO:474, SEQ ID NO:475, SEQ ID NO:476, SEQ ID NO:478, SEQ ID NO:479 or SEQ ID NO:480 (TPP-20950), n) SEQ ID NO:492, SEQ ID NO:493, SEQ ID NO:494, SEQ ID NO:496, SEQ ID NO:497 or SEQ ID NO:498 (TPP-20955), o) SEQ ID NO:510, SEQ ID NO:511, SEQ ID NO:512, SEQ ID NO:514, SEQ ID NO:515, or SEQ ID NO:516 (TPP-20965), p) SEQ ID NO:528, SEQ ID NO:529, SEQ ID NO:530, SEQ ID NO:532, SEQ ID NO:533 or SEQ ID NO:534 (TPP-21045), q) SEQ ID NO:546, SEQ ID NO:547, SEQ ID NO:548, SEQ ID NO:550, SEQ ID NO:551 or SEQ ID NO:552 (TPP-21047), r) SEQ ID NO:564, SEQ ID NO:565, SEQ ID NO:566, SEQ ID NO:568, SEQ ID NO:569 or SEQ ID NO:570 (TPP-21181), s) SEQ ID NO:582, SEQ ID NO:583, SEQ ID NO:584, SEQ ID NO:586, SEQ ID NO:587 or SEQ ID NO:588 (TPP-21183), t) SEQ ID NO:600, SEQ ID NO:601, SEQ ID NO:602, SEQ ID NO:604, SEQ ID NO:605 or SEQ ID NO:606 (TPP-21360),
u) SEQ ID NO:618, SEQ ID NO:619, SEQ ID NO:620, SEQ ID NO:622, SEQ ID NO:623 or SEQ ID NO:624 (TPP-23411),
v) SEQ ID NO:661, SEQ ID NO:662, SEQ ID NO:663, SEQ ID NO:665, SEQ ID NO:666 or SEQ ID NO:667 (TPP-29596),
w) SEQ ID NO:681, SEQ ID NO:682, SEQ ID NO:683, SEQ ID NO:685, SEQ ID NO:686 or SEQ ID NO:687 (TPP-29597),
x) SEQ ID NO:703, SEQ ID NO:704, SEQ ID NO:705, SEQ ID NO:707, SEQ ID NO:708 or SEQ ID NO:709 (TPP-18429),
y) SEQ ID NO:723, SEQ ID NO:724, SEQ ID NO:725, SEQ ID NO:727, SEQ ID NO:728 or SEQ ID NO:729 (TPP-18430),
z) SEQ ID NO:743, SEQ ID NO:744, SEQ ID NO:745, SEQ ID NO:747, SEQ ID NO:748 or SEQ ID NO:749 (TPP-18432),
aa) SEQ ID NO:763, SEQ ID NO:764, SEQ ID NO:765, SEQ ID NO:767, SEQ ID NO:768 or SEQ ID NO:769 (TPP-18433),
bb) SEQ ID NO:783, SEQ ID NO:784, SEQ ID NO:785, SEQ ID NO:787, SEQ ID NO:788 or SEQ ID NO:789 (TPP-18436),
cc) SEQ ID NO:803, SEQ ID NO:804, SEQ ID NO:805, SEQ ID NO:807, SEQ ID NO:808 or SEQ ID NO:809 (TPP-19571),
dd) SEQ ID NO:827, SEQ ID NO: 828, SEQ ID NO: 829, SEQ ID NO: 831, SEQ ID NO:832 or SEQ ID NO:833 (TPP-27477),
ee) SEQ ID NO:847, SEQ ID NO: 848, SEQ ID NO: 849, SEQ ID NO: 851, SEQ ID NO:852 or SEQ ID NO:853 (TPP-27478),
ff) SEQ ID NO:867, SEQ ID NO: 868, SEQ ID NO: 869, SEQ ID NO: 871, SEQ ID NO:872 or SEQ ID NO:873 (TPP-27479),
gg) SEQ ID NO:887, SEQ ID NO: 888, SEQ ID NO: 889, SEQ ID NO: 891, SEQ ID NO:892 or SEQ ID NO:893 (TPP-27480),
hh) SEQ ID NO:907, SEQ ID NO: 908, SEQ ID NO: 909, SEQ ID NO: 911, SEQ ID NO:912 or SEQ ID NO:913 (TPP-29367),
ii) SEQ ID NO:927, SEQ ID NO: 928, SEQ ID NO: 929, SEQ ID NO: 931, SEQ ID NO:932 or SEQ ID NO:933 (TPP-29368), and/or
jj) SEQ ID NO:947, SEQ ID NO: 948, SEQ ID NO: 949, SEQ ID NO: 951, SEQ ID NO:952 or SEQ ID NO:953 (TPP-29369).

According to some preferred embodiments, the isolated anti-CCR8 antibody or antigen-binding fragment thereof comprises a HCDR3 sequence having at least 90%, 95%, 98% or 100% sequence identity with any of SEQ ID NO:260 (TPP-16966), SEQ ID NO:278 (TPP-17575), SEQ ID NO:296 (TPP-17576), SEQ ID NO:314 (TPP-17577), SEQ ID NO:332 (TPP-17578), SEQ ID NO:350 (TPP-17579), SEQ ID NO:368 (TPP-17580), SEQ ID NO:386 (TPP-17581), SEQ ID NO:404 (TPP-18205), SEQ ID NO:422 (TPP-18206), SEQ ID NO:440 (TPP-18207), SEQ ID NO:458 (TPP-19546), SEQ ID NO:476 (TPP-20950), SEQ ID NO:494 (TPP-20955), SEQ ID NO:512 (TPP-20965), SEQ ID NO:530 (TPP-21045), SEQ ID NO:548 (TPP-21047), SEQ ID NO:566 (TPP-21181), SEQ ID NO:584 (TPP-21183), SEQ ID NO:602 (21360), or SEQ ID NO:620 (TPP-23411), SEQ ID NO:663 (TPP-29596), SEQ ID NO:683 (TPP-29597), SEQ ID NO:705 (TPP-18429), SEQ ID NO:725 (TPP-18430), SEQ ID NO:745 (TPP-18432), SEQ ID NO:765 (TPP-18433), SEQ ID NO:785 (TPP-18436), SEQ ID NO:805 (TPP-19571), SEQ ID NO:829 (TPP-27477), SEQ ID NO:849 (TPP-27478), SEQ ID NO:869 (TPP-27479), SEQ ID NO:889 (TPP-27480), SEQ ID NO:909 (TPP-29367), SEQ ID NO:929 (TPP-29368), or SEQ ID NO:949 (TPP-29369).

According to some preferred embodiments, the isolated anti-CCR8 antibody or antigen-binding fragment thereof comprises at least one, two, and preferably three, four, five or six CDR sequences according to
a) SEQ ID NO:258, SEQ ID NO:259, SEQ ID NO:260, SEQ ID NO:262, SEQ ID NO:263 and SEQ ID NO:264 (TPP-16966),
b) SEQ ID NO:276, SEQ ID NO:277, SEQ ID NO:278, SEQ ID NO:280, SEQ ID NO:281 and SEQ ID NO:282 (TPP-17575),
c) SEQ ID NO:294, SEQ ID NO:295, SEQ ID NO:296, SEQ ID NO:298, SEQ ID NO:299 and SEQ ID NO:300 (TPP-17576),
d) SEQ ID NO:312, SEQ ID NO:313, SEQ ID NO:314, SEQ ID NO:316, SEQ ID NO:317 and SEQ ID NO:318 (TPP-17577),
e) SEQ ID NO:330, SEQ ID NO:331, SEQ ID NO:332, SEQ ID NO:334, SEQ ID NO:335 and SEQ ID NO:336 (TPP-17578),
f) SEQ ID NO:348, SEQ ID NO:349, SEQ ID NO:350, SEQ ID NO:352, SEQ ID NO:353 and SEQ ID NO:354 (TPP-17579),
g) SEQ ID NO:366, SEQ ID NO:367, SEQ ID NO:368, SEQ ID NO:370, SEQ ID NO:371 and SEQ ID NO:372 (TPP-17580),
h) SEQ ID NO:384, SEQ ID NO:385, SEQ ID NO:386, SEQ ID NO:388, SEQ ID NO:389 and SEQ ID NO:390 (TPP-17581),
i) SEQ ID NO:402, SEQ ID NO:403, SEQ ID NO:404, SEQ ID NO:406, SEQ ID NO:407 and SEQ ID NO:408 (TPP-18205),
j) SEQ ID NO:420, SEQ ID NO:421, SEQ ID NO:422, SEQ ID NO:424, SEQ ID NO:425 and SEQ ID NO:426 (TPP-18206),
k) SEQ ID NO:438, SEQ ID NO:439, SEQ ID NO:440, SEQ ID NO:442, SEQ ID NO:443 and SEQ ID NO:444 (TPP-18207),
l) SEQ ID NO:456, SEQ ID NO:457, SEQ ID NO:458, SEQ ID NO:460, SEQ ID NO:461 and SEQ ID NO:462 (TPP-19546),
m) SEQ ID NO:474, SEQ ID NO:475, SEQ ID NO:476, SEQ ID NO:478, SEQ ID NO:479 and SEQ ID NO:480 (TPP-20950),
n) SEQ ID NO:492, SEQ ID NO:493, SEQ ID NO:494, SEQ ID NO:496, SEQ ID NO:497 and SEQ ID NO:498 (TPP-20955),
o) SEQ ID NO:510, SEQ ID NO:511, SEQ ID NO:512, SEQ ID NO:514, SEQ ID NO:515, and SEQ ID NO:516 (TPP-20965),
p) SEQ ID NO:528, SEQ ID NO:529, SEQ ID NO:530, SEQ ID NO:532, SEQ ID NO:533 and SEQ ID NO:534 (TPP-21045),
q) SEQ ID NO:546, SEQ ID NO:547, SEQ ID NO:548, SEQ ID NO:550, SEQ ID NO:551 and SEQ ID NO:552 (TPP-21047),
r) SEQ ID NO:564, SEQ ID NO:565, SEQ ID NO:566, SEQ ID NO:568, SEQ ID NO:569 and SEQ ID NO:570 (TPP-21181), s) SEQ ID NO:582, SEQ ID NO:583, SEQ ID NO:584, SEQ ID NO:586, SEQ ID NO:587 and SEQ ID NO:588 (TPP-21183),
t) SEQ ID NO:600, SEQ ID NO:601, SEQ ID NO:602, SEQ ID NO:604, SEQ ID NO:605 or SEQ ID NO:606 (TPP-21360),
u) SEQ ID NO:618, SEQ ID NO:619, SEQ ID NO:620, SEQ ID NO:622, SEQ ID NO:623 or SEQ ID NO:624 (TPP-23411),
v) SEQ ID NO:661, SEQ ID NO:662, SEQ ID NO:663, SEQ ID NO:665, SEQ ID NO:666 or SEQ ID NO:667 (TPP-29596),
w) SEQ ID NO:681, SEQ ID NO:682, SEQ ID NO:683, SEQ ID NO:685, SEQ ID NO:686 or SEQ ID NO:687 (TPP-29597),
x) SEQ ID NO:703, SEQ ID NO:704, SEQ ID NO:705, SEQ ID NO:707, SEQ ID NO:708 or SEQ ID NO:709 (TPP-18429),
y) SEQ ID NO:723, SEQ ID NO:724, SEQ ID NO:725, SEQ ID NO:727, SEQ ID NO:728 or SEQ ID NO:729 (TPP-18430),
z) SEQ ID NO:743, SEQ ID NO:744, SEQ ID NO:745, SEQ ID NO:747, SEQ ID NO:748 or SEQ ID NO:749 (TPP-18432),
aa) SEQ ID NO:763, SEQ ID NO:764, SEQ ID NO:765, SEQ ID NO:767, SEQ ID NO:768 or SEQ ID NO:769 (TPP-18433),
bb) SEQ ID NO:783, SEQ ID NO:784, SEQ ID NO:785, SEQ ID NO:787, SEQ ID NO:788 or SEQ ID NO:789 (TPP-18436),
cc) SEQ ID NO:803, SEQ ID NO:804, SEQ ID NO:805, SEQ ID NO:807, SEQ ID NO:808 or SEQ ID NO:809 (TPP-19571),
dd) SEQ ID NO:827, SEQ ID NO: 828, SEQ ID NO: 829, SEQ ID NO: 831, SEQ ID NO:832 or SEQ ID NO:833 (TPP-27477),
ee) SEQ ID NO:847, SEQ ID NO: 848, SEQ ID NO: 849, SEQ ID NO: 851, SEQ ID NO:852 or SEQ ID NO:853 (TPP-27478),
ff) SEQ ID NO:867, SEQ ID NO: 868, SEQ ID NO: 869, SEQ ID NO: 871, SEQ ID NO:872 or SEQ ID NO:873 (TPP-27479),
gg) SEQ ID NO:887, SEQ ID NO: 888, SEQ ID NO: 889, SEQ ID NO: 891, SEQ ID NO:892 or SEQ ID NO:893 (TPP-27480),
hh) SEQ ID NO:907, SEQ ID NO: 908, SEQ ID NO: 909, SEQ ID NO: 911, SEQ ID NO:912 or SEQ ID NO:913 (TPP-29367),
ii) SEQ ID NO:927, SEQ ID NO: 928, SEQ ID NO: 929, SEQ ID NO: 931, SEQ ID NO:932 or SEQ ID NO:933 (TPP-29368), and/or
jj) SEQ ID NO:947, SEQ ID NO: 948, SEQ ID NO: 949, SEQ ID NO: 951, SEQ ID NO:952 or SEQ ID NO:953 (TPP-29369),
optionally wherein up to one, two, three, four or five mutations have been introduced into at least one CDR. Preferably, the HCDR3 comprises or has been engineered to comprise at least one or more histidine residues as described elsewhere herein.

For example, tyrosine may be exchanged with a positively charged amino acid such as histidine and vice versa. For example, a positively charged amino acid may be exchanged with a different positively charged amino acid, a negatively charged amino acid may be exchanged with a different negatively charged amino acid, a polar amino acid may be exchanged with a different polar amino acid, a polar uncharged amino acid may be exchanged with a different polar uncharged amino acid, a small amino acid may be exchanged with a different small amino acid, an amphiphatic amino acid may be exchanged with a different amphiphatic amino acid, an aromatic amino acid may be exchanged with a different aromatic amino acid. As understood by the skilled person, in particular those amino acid exchanges are possible, which are not altering the specific interaction between the antibody and the sulfated TRD of CCR8.

According to some preferred embodiments, the isolated anti-CCR8 antibody or antigen-binding fragment thereof comprises a variable heavy chain sequence and/or a variable light chain sequence having at least 90%, 95%, 98% or 100% sequence identity with
a) a variable heavy chain sequence according to SEQ ID NO:257 and/or a variable light chain sequence according to SEQ ID NO:261 (TPP-16966),
b) a variable heavy chain sequence according to SEQ ID NO:275 and/or a variable light chain sequence according to SEQ ID NO:279 (TPP-17575),
c) a variable heavy chain sequence according to SEQ ID NO:293 and/or a variable light chain sequence according to SEQ ID NO:297 (TPP-17576),
d) a variable heavy chain sequence according to SEQ ID NO:311 and/or a variable light chain sequence according to SEQ ID NO:315 (TPP-17577),
e) a variable heavy chain sequence according to SEQ ID NO:329 and/or a variable light chain sequence according to SEQ ID NO:333 (TPP-17578),
f) a variable heavy chain sequence according to SEQ ID NO:347 and/or a variable light chain sequence according to SEQ ID NO:351 (TPP-17579),
g) a variable heavy chain sequence according to SEQ ID NO:365 and/or a variable light chain sequence according to SEQ ID NO:369 (TPP-17580),
h) a variable heavy chain sequence according to SEQ ID NO:383 and/or a variable light chain sequence according to SEQ ID NO:387 (TPP-17581),
i) a variable heavy chain sequence according to SEQ ID NO:401 and/or a variable light chain sequence according to SEQ ID NO:405 (TPP-18205),
j) a variable heavy chain sequence according to SEQ ID NO:419 and/or a variable light chain sequence according to SEQ ID NO:423 (TPP-18206),
k) a variable heavy chain sequence according to SEQ ID NO:437 and/or a variable light chain sequence according to SEQ ID NO:441 (TPP-18207),
l) a variable heavy chain sequence according to SEQ ID NO:455 and/or a variable light chain sequence according to SEQ ID NO:459 (TPP-19546),
m) a variable heavy chain sequence according to SEQ ID NO:473 and/or a variable light chain sequence according to SEQ ID NO:477 (TPP-20950),
n) a variable heavy chain sequence according to SEQ ID NO:491 and/or a variable light chain sequence according to SEQ ID NO:495 (TPP-20955),
o) a variable heavy chain sequence according to SEQ ID NO:509 and/or a variable light chain sequence according to SEQ ID NO:513 (TPP-20965),
p) a variable heavy chain sequence according to SEQ ID NO:527 and/or a variable light chain sequence according to SEQ ID NO:531 (TPP-21045),
q) a variable heavy chain sequence according to SEQ ID NO:545 and/or a variable light chain sequence according to SEQ ID NO:549 (TPP-21047),
r) a variable heavy chain sequence according to SEQ ID NO:563 and/or a variable light chain sequence according to SEQ ID NO:567 (TPP-21181), s) a variable heavy chain sequence according to SEQ ID NO:581 and/or a variable light chain sequence according to SEQ ID NO:585 (TPP-21183),
t) a variable heavy chain sequence according to SEQ ID NO:599 and/or a variable light chain sequence according to SEQ ID NO:603 (TPP-21360),
u) a variable heavy chain sequence according to SEQ ID NO:617 and/or a variable light chain sequence according to SEQ ID NO:621 (TPP-23411),
v) a variable heavy chain sequence according to SEQ ID NO:660 and/or a variable light chain sequence according to SEQ ID NO:664 (TPP-29596),
w) a variable heavy chain sequence according to SEQ ID NO:680 and/or a variable light chain sequence according to SEQ ID NO:684 (TPP-29597),
x) a variable heavy chain sequence according to SEQ ID NO:702 and/or a variable light chain sequence according to SEQ ID NO:706 (TPP-18429),
y) a variable heavy chain sequence according to SEQ ID NO:722 and/or a variable light chain sequence according to SEQ ID NO:726 (TPP-18430),
z) a variable heavy chain sequence according to SEQ ID NO:742 and/or a variable light chain sequence according to SEQ ID NO:746 (TPP-18432),
aa) a variable heavy chain sequence according to SEQ ID NO:762 and/or a variable light chain sequence according to SEQ ID NO:766 (TPP-18433),
bb) a variable heavy chain sequence according to SEQ ID NO:782 and/or a variable light chain sequence according to SEQ ID NO:786 (TPP-18436),
cc) a variable heavy chain sequence according to SEQ ID NO:802 and/or a variable light chain sequence according to SEQ ID NO:806 (TPP-19571),
dd) a variable heavy chain sequence according to SEQ ID NO:826 and/or a variable light chain sequence according to SEQ ID NO:830 (TPP-27477),
ee) a variable heavy chain sequence according to SEQ ID NO:846 and/or a variable light chain sequence according to SEQ ID NO:850 (TPP-27478),
ff) a variable heavy chain sequence according to SEQ ID NO:866 and/or a variable light chain sequence according to SEQ ID NO:870 (TPP-27479),
gg) a variable heavy chain sequence according to SEQ ID NO:886 and/or a variable light chain sequence according to SEQ ID NO:890 (TPP-27480),
hh) a variable heavy chain sequence according to SEQ ID NO:906 and/or a variable light chain sequence according to SEQ ID NO:910 (TPP-29367),
ii) a variable heavy chain sequence according to SEQ ID NO:926 and/or a variable light chain sequence according to SEQ ID NO:930 (TPP-29368), or
jj) a variable heavy chain sequence according to SEQ ID NO:946 and/or a variable light chain sequence according to SEQ ID NO:950 (TPP-29369).

According to some preferred embodiments, the isolated anti-CCR8 antibody or antigen-binding fragment thereof comprises a) a variable heavy chain sequence according to SEQ ID NO:257 and/or a variable light chain sequence according to SEQ ID NO:261 (TPP-16966),
b) a variable heavy chain sequence according to SEQ ID NO:275 and/or a variable light chain sequence according to SEQ ID NO:279 (TPP-17575),
c) a variable heavy chain sequence according to SEQ ID NO:293 and/or a variable light chain sequence according to SEQ ID NO:297 (TPP-17576),
d) a variable heavy chain sequence according to SEQ ID NO:311 and/or a variable light chain sequence according to SEQ ID NO:315 (TPP-17577),
e) a variable heavy chain sequence according to SEQ ID NO:329 and/or a variable light chain sequence according to SEQ ID NO:333 (TPP-17578),
f) a variable heavy chain sequence according to SEQ ID NO:347 and/or a variable light chain sequence according to SEQ ID NO:351 (TPP-17579),
g) a variable heavy chain sequence according to SEQ ID NO:365 and/or a variable light chain sequence according to SEQ ID NO:369 (TPP-17580),
h) a variable heavy chain sequence according to SEQ ID NO:383 and/or a variable light chain sequence according to SEQ ID NO:387 (TPP-17581),
i) a variable heavy chain sequence according to SEQ ID NO:401 and/or a variable light chain sequence according to SEQ ID NO:405 (TPP-18205),
j) a variable heavy chain sequence according to SEQ ID NO:419 and/or a variable light chain sequence according to SEQ ID NO:423 (TPP-18206),
k) a variable heavy chain sequence according to SEQ ID NO:437 and/or a variable light chain sequence according to SEQ ID NO:441 (TPP-18207),
l) a variable heavy chain sequence according to SEQ ID NO:455 and/or a variable light chain sequence according to SEQ ID NO:459 (TPP-19546),
m) a variable heavy chain sequence according to SEQ ID NO:473 and/or a variable light chain sequence according to SEQ ID NO:477 (TPP-20950),
n) a variable heavy chain sequence according to SEQ ID NO:491 and/or a variable light chain sequence according to SEQ ID NO:495 (TPP-20955),
o) a variable heavy chain sequence according to SEQ ID NO:509 and/or a variable light chain sequence according to SEQ ID NO:513 (TPP-20965),
p) a variable heavy chain sequence according to SEQ ID NO:527 and/or a variable light chain sequence according to SEQ ID NO:531 (TPP-21045),
q) a variable heavy chain sequence according to SEQ ID NO:545 and/or a variable light chain sequence according to SEQ ID NO:549 (TPP-21047),
r) a variable heavy chain sequence according to SEQ ID NO:563 and/or a variable light chain sequence according to SEQ ID NO:567 (TPP-21181),
s) a variable heavy chain sequence according to SEQ ID NO:581 and/or a variable light chain sequence according to SEQ ID NO:585 (TPP-21183),
t) a variable heavy chain sequence according to SEQ ID NO:599 and/or a variable light chain sequence according to SEQ ID NO:603 (TPP-21360),
u) a variable heavy chain sequence according to SEQ ID NO:617 and/or a variable light chain sequence according to SEQ ID NO:621 (TPP-23411),
v) a variable heavy chain sequence according to SEQ ID NO:660 and/or a variable light chain sequence according to SEQ ID NO:664 (TPP-29596),
w) a variable heavy chain sequence according to SEQ ID NO:680 and/or a variable light chain sequence according to SEQ ID NO:684 (TPP-29597),
x) a variable heavy chain sequence according to SEQ ID NO:702 and/or a variable light chain sequence according to SEQ ID NO:706 (TPP-18429),
y) a variable heavy chain sequence according to SEQ ID NO:722 and/or a variable light chain sequence according to SEQ ID NO:726 (TPP-18430), z) a variable heavy chain sequence according to SEQ ID NO:742 and/or a variable light chain sequence according to SEQ ID NO:746 (TPP-18432),
aa) a variable heavy chain sequence according to SEQ ID NO:762 and/or a variable light chain sequence according to SEQ ID NO:766 (TPP-18433),
bb) a variable heavy chain sequence according to SEQ ID NO:782 and/or a variable light chain sequence according to SEQ ID NO:786 (TPP-18436),
cc) a variable heavy chain sequence according to SEQ ID NO:802 and/or a variable light chain sequence according to SEQ ID NO:806 (TPP-19571),
dd) a variable heavy chain sequence according to SEQ ID NO:826 and/or a variable light chain sequence according to SEQ ID NO:830 (TPP-27477),
ee) a variable heavy chain sequence according to SEQ ID NO:846 and/or a variable light chain sequence according to SEQ ID NO:850 (TPP-27478),
ff) a variable heavy chain sequence according to SEQ ID NO:866 and/or a variable light chain sequence according to SEQ ID NO:870 (TPP-27479),
gg) a variable heavy chain sequence according to SEQ ID NO:886 and/or a variable light chain sequence according to SEQ ID NO:890 (TPP-27480),
hh) a variable heavy chain sequence according to SEQ ID NO:906 and/or a variable light chain sequence according to SEQ ID NO:910 (TPP-29367),
ii) a variable heavy chain sequence according to SEQ ID NO:926 and/or a variable light chain sequence according to SEQ ID NO:930 (TPP-29368), or
jj) a variable heavy chain sequence according to SEQ ID NO:946 and/or a variable light chain sequence according to SEQ ID NO:950 (TPP-29369).

According to some preferred embodiments, the isolated anti-CCR8 antibody or antigen-binding fragment thereof comprises a heavy chain sequence and/or a light chain sequence having at least 90%, 95%, 98% or 100% sequence identity with a) a heavy chain according to SEQ ID NO:273 and a light chain according to SEQ ID NO:274 (TPP-16966),
b) a heavy chain according to SEQ ID NO:291 and a light chain according to SEQ ID NO:292 (TPP-17575),
c) a heavy chain according to SEQ ID NO:309 and a light chain according to SEQ ID NO:310 (TPP-17576),
d) a heavy chain according to SEQ ID NO:327 and a light chain according to SEQ ID NO:328 (TPP-17577),
e) a heavy chain according to SEQ ID NO:345 and a light chain according to SEQ ID NO:346 (TPP-17578),
f) a heavy chain according to SEQ ID NO:363 and a light chain according to SEQ ID NO:364 (TPP-17579),
g) a heavy chain according to SEQ ID NO:381 and a light chain according to SEQ ID NO:382 (TPP-17580),
h) a heavy chain according to SEQ ID NO:399 and a light chain according to SEQ ID NO:400 (TPP-17581),
i) a heavy chain according to SEQ ID NO:417 and a light chain according to SEQ ID NO:418 (TPP-18205),
j) a heavy chain according to SEQ ID NO:435 and a light chain according to SEQ ID NO:436 (TPP-18206),
k) a heavy chain according to SEQ ID NO:453 and a light chain according to SEQ ID NO:454 (TPP-18207),
l) a heavy chain according to SEQ ID NO:471 and a light chain according to SEQ ID NO:472 (TPP-19546),
m) a heavy chain according to SEQ ID NO:489 and a light chain according to SEQ ID NO:490 (TPP-20950),
n) a heavy chain according to SEQ ID NO:507 and a light chain according to SEQ ID NO:508 (TPP-20955),
o) a heavy chain according to SEQ ID NO:525 and a light chain according to SEQ ID NO:526 (TPP-20965),
p) a heavy chain according to SEQ ID NO:543 and a light chain according to SEQ ID NO:544 (TPP-21045),
q) a heavy chain according to SEQ ID NO:561 and a light chain according to SEQ ID NO:562 (TPP-21047),
r) a heavy chain according to SEQ ID NO:579 and a light chain according to SEQ ID NO:580 (TPP-21181),
s) a heavy chain according to SEQ ID NO:597 and a light chain according to SEQ ID NO:598 (TPP-21183),
t) a heavy chain according to SEQ ID NO:615 and a light chain according to SEQ ID NO:616 (TPP-21360),
u) a heavy chain according to SEQ ID NO:633 and a light chain according to SEQ ID NO:634 (TPP-23411),
v) a heavy chain according to SEQ ID NO:676 and a light chain according to SEQ ID NO:677 (TPP-29596),
w) a heavy chain according to SEQ ID NO:696 and a light chain according to SEQ ID NO:697 (TPP-29597),
x) a heavy chain according to SEQ ID NO:718 and a light chain according to SEQ ID NO:719 (TPP-18429),
y) a heavy chain according to SEQ ID NO:738 and a light chain according to SEQ ID NO:739 (TPP-18430),
z) a heavy chain according to SEQ ID NO:758 and a light chain according to SEQ ID NO:759 (TPP-18432),
aa) a heavy chain according to SEQ ID NO:778 and a light chain according to SEQ ID NO:779 (TPP-18433),
bb) a heavy chain according to SEQ ID NO:798 and a light chain according to SEQ ID NO:799 (TPP-18436),
cc) a heavy chain according to SEQ ID NO:818 and a light chain according to SEQ ID NO:819 (TPP-19571),
dd) a heavy chain according to SEQ ID NO:842 and a light chain according to SEQ ID NO:843 (TPP-27477),
ee) a heavy chain according to SEQ ID NO:862 and a light chain according to SEQ ID NO:863 (TPP-27478),
ff) a heavy chain according to SEQ ID NO:882 and a light chain according to SEQ ID NO:883 (TPP-27479),
gg) a heavy chain according to SEQ ID NO:902 and a light chain according to SEQ ID NO:903 (TPP-27480),
hh) a heavy chain according to SEQ ID NO:922 and a light chain according to SEQ ID NO:923 (TPP-29367),
ii) a heavy chain according to SEQ ID NO:942 and a light chain according to SEQ ID NO:943 (TPP-29368), or
jj) a heavy chain according to SEQ ID NO:962 and a light chain according to SEQ ID NO:963 (TPP-29369).

According to some preferred embodiments, the isolated anti-CCR8 antibody or antigen-binding fragment thereof comprises a) a heavy chain according to SEQ ID NO:273 and a light chain according to SEQ ID NO:274 (TPP-16966),
b) a heavy chain according to SEQ ID NO:291 and a light chain according to SEQ ID NO:292 (TPP-17575),
c) a heavy chain according to SEQ ID NO:309 and a light chain according to SEQ ID NO:310 (TPP-17576),
d) a heavy chain according to SEQ ID NO:327 and a light chain according to SEQ ID NO:328 (TPP-17577),
e) a heavy chain according to SEQ ID NO:345 and a light chain according to SEQ ID NO:346 (TPP-17578),
f) a heavy chain according to SEQ ID NO:363 and a light chain according to SEQ ID NO:364 (TPP-17579),
g) a heavy chain according to SEQ ID NO:381 and a light chain according to SEQ ID NO:382 (TPP-17580),
h) a heavy chain according to SEQ ID NO:399 and a light chain according to SEQ ID NO:400 (TPP-17581),
i) a heavy chain according to SEQ ID NO:417 and a light chain according to SEQ ID NO:418 (TPP-18205),
j) a heavy chain according to SEQ ID NO:435 and a light chain according to SEQ ID NO:436 (TPP-18206), k) a heavy chain according to SEQ ID NO:453 and a light chain according to SEQ ID NO:454 (TPP-18207),
l) a heavy chain according to SEQ ID NO:471 and a light chain according to SEQ ID NO:472 (TPP-19546),
m) a heavy chain according to SEQ ID NO:489 and a light chain according to SEQ ID NO:490 (TPP-20950),
n) a heavy chain according to SEQ ID NO:507 and a light chain according to SEQ ID NO:508 (TPP-20955),
o) a heavy chain according to SEQ ID NO:525 and a light chain according to SEQ ID NO:526 (TPP-20965),
p) a heavy chain according to SEQ ID NO:543 and a light chain according to SEQ ID NO:544 (TPP-21045),
q) a heavy chain according to SEQ ID NO:561 and a light chain according to SEQ ID NO:562 (TPP-21047),
r) a heavy chain according to SEQ ID NO:579 and a light chain according to SEQ ID NO:580 (TPP-21181),
s) a heavy chain according to SEQ ID NO:597 and a light chain according to SEQ ID NO:598 (TPP-21183),
t) a heavy chain according to SEQ ID NO:615 and a light chain according to SEQ ID NO:616 (TPP-21360),
u) a heavy chain according to SEQ ID NO:633 and a light chain according to SEQ ID NO:634 (TPP-23411),
v) a heavy chain according to SEQ ID NO:676 and a light chain according to SEQ ID NO:677 (TPP-29596),
w) a heavy chain according to SEQ ID NO:696 and a light chain according to SEQ ID NO:697 (TPP-29597),
x) a heavy chain according to SEQ ID NO:718 and a light chain according to SEQ ID NO:719 (TPP-18429),
y) a heavy chain according to SEQ ID NO:738 and a light chain according to SEQ ID NO:739 (TPP-18430),
z) a heavy chain according to SEQ ID NO:758 and a light chain according to SEQ ID NO:759 (TPP-18432),
aa) a heavy chain according to SEQ ID NO:778 and a light chain according to SEQ ID NO:779 (TPP-18433),
bb) a heavy chain according to SEQ ID NO:798 and a light chain according to SEQ ID NO:799 (TPP-18436),
cc) a heavy chain according to SEQ ID NO:818 and a light chain according to SEQ ID NO:819 (TPP-19571),
dd) a heavy chain according to SEQ ID NO:842 and a light chain according to SEQ ID NO:843 (TPP-27477),
ee) a heavy chain according to SEQ ID NO:862 and a light chain according to SEQ ID NO:863 (TPP-27478),
ff) a heavy chain according to SEQ ID NO:882 and a light chain according to SEQ ID NO:883 (TPP-27479),
gg) a heavy chain according to SEQ ID NO:902 and a light chain according to SEQ ID NO:903 (TPP-27480),
hh) a heavy chain according to SEQ ID NO:922 and a light chain according to SEQ ID NO:923 (TPP-29367),
ii) a heavy chain according to SEQ ID NO:942 and a light chain according to SEQ ID NO:943 (TPP-29368), or
jj) a heavy chain according to SEQ ID NO:962 and a light chain according to SEQ ID NO:963 (TPP-29369).

Also provided according to the current aspect are various antibodies comprising random permutations of the CDRs of the anti-CCR8 antibodies provided with the sequence listings.

Preferably, the antibody or antigen-binding fragment according to the current aspect is afucosylated, as described elsewhere herein. Preferably, the antibody or antigen-binding fragment according to the current aspect induces ADCC and/or ADCP, as described elsewhere herein. Preferably, the antibody or antigen-binding fragment according to the current aspect is a non-internalizing or low-internalizing antibody, as described elsewhere herein.

Aspect 18—Anti-Murine Ccr8 Antibody (SEQ Defined)

According to an 18$^{th}$ aspect, which may be or may not be the same as the 6th, 7th, 8th, 9th, 10th, 11th, 12th, 13th, 14$^{th}$, 15$^{th}$ and/or 16$^{th}$ aspect, there is provided an isolated anti-CCR8 antibody or antigen-binding fragment thereof. Preferably, the antibodies according to the current aspect bind to murine CCR8, in particular to an isolated polypeptide according to SEQ ID NO:45 and/or SEQ ID NO:48, wherein at least two or all of Y3, Y14 and Y15 have been sulfated. The CDRs of the antibodies according to the current aspect are preferably human derived CDRs. Furthermore, the antibodies are characterized by properties making them particularly suitable for therapy, e.g. are antibodies according to at least one or more of aspects 7, 8, 9, 10, 11, 12, 13, 14, 15 or 16. In summary, the antibodies according to the current aspect can be used as surrogate antibodies recognizing murine CCR8 and have superior therapeutic properties as discussed e.g. in example 12.

According to some preferred embodiments, the isolated anti-CCR8 antibody or antigen-binding fragment thereof comprises at least one, two, three, four, five or six CDR sequence(s) having at least 90%, 95%, 98% or 100% sequence identity with any of a) SEQ ID NO:202, SEQ ID NO:203, SEQ ID NO:204, SEQ ID NO:206, SEQ ID NO:207 and SEQ ID NO:208 (TPP-14095),
b) SEQ ID NO:216, SEQ ID NO:217, SEQ ID NO:218, SEQ ID NO:220, SEQ ID NO:221 or SEQ ID NO:222 (TPP-14099),
c) SEQ ID NO:230, SEQ ID NO:231, SEQ ID NO:232, SEQ ID NO:234, SEQ ID NO:235 and SEQ ID NO:236 (TPP-15285), or
d) SEQ ID NO:244, SEQ ID NO:245, SEQ ID NO:246, SEQ ID NO:248, SEQ ID NO:249 and SEQ ID NO:250 (TPP-15286).

According to some preferred embodiments, the isolated anti-CCR8 antibody or antigen-binding fragment thereof comprises a HCDR3 sequence having at least 90%, 95%, 98% or 100% sequence identity with any of SEQ ID NO:204, SEQ ID NO:218, SEQ ID NO:232, or SEQ ID NO:246.

According to some preferred embodiments, the isolated anti-CCR8 antibody or antigen-binding fragment thereof comprises at least one, two, and preferably three, four, five or six CDR sequences according to a) SEQ ID NO:202, SEQ ID NO:203, SEQ ID NO:204, SEQ ID NO:206, SEQ ID NO:207 and SEQ ID NO:208 (TPP-14095),
b) SEQ ID NO:216, SEQ ID NO:217, SEQ ID NO:218, SEQ ID NO:220, SEQ ID NO:221 or SEQ ID NO:222 (TPP-14099),
c) SEQ ID NO:230, SEQ ID NO:231, SEQ ID NO:232, SEQ ID NO:234, SEQ ID NO:235 and SEQ ID NO:236 (TPP-15285), or
d) SEQ ID NO:244, SEQ ID NO:245, SEQ ID NO:246, SEQ ID NO:248, SEQ ID NO:249 and SEQ ID NO:250 (TPP-15286),
optionally wherein up to one, two, three, four or five mutations have been introduced into at least one CDR.

For example, tyrosine may be exchanged with a positively charged amino acid such as histidine and vice versa. For example, a positively charged amino acid may be exchanged with a different positively charged amino acid, a negatively charged amino acid may be exchanged with a different negatively charged amino acid, a polar amino acid may be exchanged with a different polar amino acid, a polar uncharged amino acid may be exchanged with a different polar uncharged amino acid, a small amino acid may be exchanged with a different small amino acid, an amphiphatic amino acid may be exchanged with a different amphiphatic amino acid, an aromatic amino acid may be exchanged with a different aromatic amino acid. As understood by the skilled person, in particular those amino acid exchanges are possible, which are not altering the specific interaction between the antibody and the sulfated TRD of CCR8. Amino acid exchanges introducing histidine are preferred.

According to some preferred embodiments, the isolated anti-CCR8 antibody or antigen-binding fragment thereof comprises a variable heavy chain sequence and/or a variable light chain sequence having at least 90%, 95%, 98% or 100% sequence identity with
a) a variable heavy chain sequence according to SEQ ID NO:201 and a variable light chain sequence according to SEQ ID NO:205 (TPP-14095),
b) a variable heavy chain sequence according to SEQ ID NO:215 and a variable light chain sequence according to SEQ ID NO:219 (TPP-14099),
c) a variable heavy chain sequence according to SEQ ID NO:229 and a variable light chain sequence according to SEQ ID NO:233 (TPP-15285), or
d) a variable heavy chain sequence according to SEQ ID NO:243 and a variable light chain sequence according to SEQ ID NO:247 (TPP-15286).

According to some preferred embodiments, the anti-CCR8 antibody or antigen-binding fragment thereof comprises
e) a variable heavy chain sequence according to SEQ ID NO:201 and a variable light chain sequence according to SEQ ID NO:205 (TPP-14095),
f) a variable heavy chain sequence according to SEQ ID NO:215 and a variable light chain sequence according to SEQ ID NO:219 (TPP-14099),
g) a variable heavy chain sequence according to SEQ ID NO:229 and a variable light chain sequence according to SEQ ID NO:233 (TPP-15285), or
h) a variable heavy chain sequence according to SEQ ID NO:243 and a variable light chain sequence according to SEQ ID NO:247 (TPP-15286).

According to some preferred embodiments, the isolated anti-CCR8 antibody or antigen-binding fragment thereof comprises a heavy chain sequence and/or a light chain sequence having at least 90%, 95%, 98% or 100% sequence identity with
a) a heavy chain according to SEQ ID NO:211 and/or a light chain according to SEQ ID NO:212 (TPP-14095),
b) a heavy chain according to SEQ ID NO:225 and/or a light chain according to SEQ ID NO:226 (TPP-14099),
c) a heavy chain according to SEQ ID NO:239 and/or a light chain according to SEQ ID NO:240 (TPP-15285), or
d) a heavy chain according to SEQ ID NO:253 and/or a light chain according to SEQ ID NO:254 (TPP-15286).

According to some preferred embodiments, the isolated anti-CCR8 antibody or antigen-binding fragment thereof comprises
a) a heavy chain according to SEQ ID NO:211 and/or a light chain according to SEQ ID NO:212 (TPP-14095),
b) a heavy chain according to SEQ ID NO:225 and/or a light chain according to SEQ ID NO:226 (TPP-14099),
c) a heavy chain according to SEQ ID NO:239 and/or a light chain according to SEQ ID NO:240 (TPP-15285), or
d) a heavy chain according to SEQ ID NO:253 and/or a light chain according to SEQ ID NO:254 (TPP-15286).

Preferred Combinations According to "all Aspects"

The following embodiments are particularly preferred embodiments of aspects 6, 7, 8, 9, 10, 11, 12, 13, 14, 15, 16, 17 and 18 ("all aspects" according to this section).

In preferred embodiments of all aspects, the antibody or antigen-binding fragment the isolated antibody or antigen-binding fragment thereof specifically binds to the sulfated tyrosine rich domain of CCR8. In preferred embodiments of all aspects, the antibody or antigen-binding fragment is characterized by a HCDR3 region comprising between 10 and 34% of tyrosine and/or between 2 and 20% of histidine. In preferred embodiments of all aspects, the antibody or antigen-binding fragment is non-internalizing or is characterized by an internalization into a cell with endogenous target expression which is lower than the 1.5, 2, 3, 4, 5, 6, 7, or 10-fold of the internalization of the isotype control.

In preferred embodiments of all aspects, the antibody or antigen-binding fragment comprises human (derived) CDRs. For example, the antibody can be a human anti-human CCR8 antibody. In preferred embodiments of all aspects, the antibody or antigen-binding fragment is cross reactive for CCR8 from at least two species, preferably selected from human, monkey, *Macaca fascicularis* (cynomolgus monkey), *Macaca mulatta* (Rhesus macaque), rodent, mouse, rat, horse, bovine, pig, dog, cat and camel, even more preferably selected from human, cynomolgus and mouse. According to some most preferred of these embodiments, the antibody or antigen-binding fragment is cross reactive for human and cynomolgus CCR8.

In preferred embodiments of all aspects, the antibody or antigen-binding fragment binds the CCR8 from a first species with a first dissociation constant KD and binds the CCR8 from a second species with a second dissociation constant KD, wherein the first and the second dissociation constant are in the same order of magnitude.

In preferred embodiments of all aspects the antibody or antigen-binding fragment binds with a KD value of <5E-8 M, <4E-8 M, <3E-8 M, <2E-8 M, <1E-8 M, <9E-9 M, <8E-9 M, <7E-9 M, <6E-9 M, <5E-9 M, <4E-9 M, <3E-9 M, <2.5E-9 M, <2E-9 M, <1.5E-9 M, <1E-9 M, <9E-10 M, <8E-10 M, <7E-10 M, <6E-10 M, <5E-10 M, <4E-10 M, <3E-10 M, <2.5E-10 M, <2E-10 M, <1.5E-10 M, <1E-10 M, or <9E-11 M
a) to an isolated polypeptide according to SEQ ID NO:43 and/or SEQ ID NO:46, wherein at least two or all of Y3, Y15 and Y17 have been sulfated, and/or
b) to an isolated polypeptide according to SEQ ID NO:44 and/or SEQ ID NO:47, wherein at least two or all of Y3, Y15 and Y17 have been sulfated, and/or
c) to an isolated polypeptide according to SEQ ID NO:45 and/or SEQ ID NO:48, wherein at least two or all of Y3, Y14 and Y15 have been sulfated.

In preferred embodiments of all aspects, the antibody or antigen-binding fragment (specifically) binds with an EC50 of <15 nM, <10 nM, <5 nM, <1 nM or <0.6 nM
a) to human CCR8 and/or to an isolated polypeptide according to SEQ ID NO:43 and/or SEQ ID NO:46, wherein at least two or all of Y3, Y15 and Y17 have been sulfated, and/or
b) to cynomolgus CCR8 and/or to an isolated polypeptide according to SEQ ID NO:44 and/or SEQ ID NO:47, wherein at least two or all of Y3, Y15 and Y17 have been sulfated, and/or
c) to murine CCR8 and/or to an isolated polypeptide according to SEQ ID NO:45 and/or SEQ ID NO:48, wherein at least two or all of Y3, Y14 and Y15 have been sulfated, and optionally binds with an EC50 of <50 nM, <25 nM, <15 nM or <10 nM to activated human regulatory T cells.

According to some most preferred of these embodiments, the EC50 of the antibody or antigen-binding fragment for binding to human CCR8 or to an isolated polypeptide according to SEQ ID NO:46, wherein at least two or all of Y3, Y15 and Y17 have been sulfated, is below 10 nM, 5 nM, 2.5 nM, 1 nM, 0.5 nM or 0.25 nM and the EC50 of the antibody or antigen-binding fragment for binding to cynomolgus CCR8 or to an isolated polypeptide according to SEQ ID NO:47, wherein at least two or all of Y3, Y15 and Y17 have been sulfated, is below 10 nM, 5 nM, 2.5 nM, 1 nM, 0.5 nM or 0.25 nM.

As disclosed for instance in example 10.1.1, the antibodies according to the current invention have excellent affinities for their respective target. For example, cross reactive antibodies TPP-21181, TPP-17578, TPP-19546, TPP-18206, TPP-21360 and TPP-23411 bound human CCR8 with an EC50 of 4.8 nM, 1.7 nM, 0.8 nM, 0.6 nM, ~0.9 nM or 1.7 nM. Also, TPP-21181, TPP-17578, TPP-19546, TPP-18206, TPP-21360 and TPP-23411 bound cynomolgus CCR8 with an EC50 of 1.8 nM, 1 nM, 0.5 nM, 0.7 nM, ~0.55 nM or 0.9 nM. In addition, TPP-17578, TPP-19546, TPP-18206, and TPP-21360 bound to human regulatory T cells with an EC50 of 25 nM, 15 nM, 23 nM or 10 nM. In addition, anti-murine CCR8 antibody TPP-14099 binds CHO cells expressing murine CCR8 with an EC50 of 3 nM and murine iTregs with an EC50 of 13.2 nM, cf. Table 10.1.1.5.

In preferred embodiments of all aspects, the antibody or antigen-binding fragment, preferably at a concentration of 10 nM,
a) does not or not substantially or to a lower degree than antibodies L263G8 and 433H block CCL1 induced β-arrestin signaling, and/or
b) does not or not substantially or to a lower degree than antibodies L263G8 and 433H induce ERK1/2 phosphorylation and/or
c) does not or not substantially or to a lower degree than antibodies L263G8 and 433H induce AKT phosphorylation.

In preferred embodiments of all aspects, the antibody or antigen-binding fragment blocks G protein dependent signaling of the chemokine receptor.

In preferred embodiments of all aspects, the antibody or antigen-binding fragment is afucosylated.

In preferred embodiments of all aspects, the antibody or antigen-binding fragment
a) binds to human Fc gamma receptor IIIA variant V176 (CD16a) with a dissociation constant (KD) lower than 530 nM, 500 nM, 450 nM, 400 nM, 300 nM or 200 nM, and/or
b) binds to human Fc gamma RITA (CD32a) with a dissociation constant (KD) lower than 30 µM, 20 µM, 10 µM, 5 µM or 1 µM.

In preferred embodiments of all aspects, the antibody or antigen-binding fragment
a) induces antibody-dependent cell-mediated cytotoxicity (ADCC) in target cells expressing human CCR8 via human effector cells, such as human NK cells, and/or
b) induces antibody-dependent cell-mediated phagocytosis (ADCP) in target cells expressing human CCR8 via human effector cells, such as human macrophages.

In preferred embodiments of all aspects, the antibody or antigen-binding fragment induces ADCC and/or ADCP and
a) the ADCC-induced maximal depletion of activated human regulatory T cells is at least 30%, 40%, 50%, 60%, 70%, 80%, 90%, 95%, 98% or 99%, and/or
b) the ADCP-induced maximal depletion of activated human regulatory T cells is at least at least 5%, 10%, 15%, 20%, 25%, 30%, 40% or 50%, and/or
c) the maximal depletion of intra-tumoral regulatory T cells, in vitro or in a subject, is at least 50%, 60%, 70%, 80%, 90%, 95% or 99%.

In preferred embodiments of all aspects, the EC50 of the antibody or antigen-binding fragment
a) for ADCC-induced depletion of activated human regulatory T cells is below 100 pM, 50 pM, 25 pM, 12.5 pM, 10 pM or 5 pM and/or
b) for ADCP-induced depletion of activated human regulatory T cells is below 500 pM, 250 pM, 200 pM, 150 pM, 100 pM, 75 pM, 50 pM or 25 pM.

In preferred embodiments of all aspects, an effective dose of the antibody or antigen-binding fragment
a) decreases the number of activated or intra-tumoral regulatory T cells, in vitro or in a subject, to less than 30%, 25%, 20%, 10%, 5% or 1% and/or
b) increases the ratio of intra-tumoral CD8+ T cells to intra-tumoral Tregs, in vitro or in a subject, to at least 5, 10, 15, 20, 25, 30, 40, 50, 60, 70, 80, 90, 100, 150, 200, or higher and/or
c) decreases the percentage of regulatory T cells of intra-tumoral CD4+ T cells, in vitro or in a subject, to <30%, <20%, <10% or <5%.

In preferred embodiments of all aspects, the antibody or antigen-binding fragment increases the absolute numbers of immune cells in a defined tumor volume, at least by a factor of 1.5, 2, 2.5, 3, 3.5 or 4, preferably wherein the immune cells are selected from
a) (intra-tumoral) CD45+ cells,
b) (intra-tumoral) CD8+ T cells,
c) (intra-tumoral) CD4+ T cells,
d) (intra-tumoral) macrophages, such as M1 macrophages or M2 macrophages,
e) (intra-tumoral) NK cells,
f) (intra-tumoral) B cells,
g) (intra-tumoral) Dendritic cells,
h) (intra-tumoral) Gamma delta T cells,
i) (intra-tumoral) iNKT cells,
or any combination thereof.

For example, the immune cells are
a) CD8+ T cells, CD4+ T cells, and macrophages, or
b) CD8+ T cells, CD4+ T cells, NK cells and macrophages, or
c) CD8+ T cells, ACOD1+ macrophages (M1 macrophages), and B cells.

In preferred embodiments of all aspects, three or more effective doses of the antibody or antigen-binding fragment, in a tumor, increase
a) the number of intra-tumoral CD8+ T cells to at least 150%, 200%, 250%, 300% or 350%,
b) the ratio of intra-tumoral CD8+ T cells to intra-tumoral regulatory T cells to at least 4, 5, 10, 15, 20, 25, 30, 40, 50, 60, 70, 80, 90, 100, 150, 200, or higher,
c) the number of intra-tumoral macrophages at least by a factor of 2, 3, 4, or 5,
d) the number of intra-tumoral ACOD1+ macrophages (M1 macrophages) at least by a factor of 2, 3, 4, 5, 6, 7, 8, 9 or 10,
e) the ratio of ACOD1+ macrophages (M1 macrophages) to MRC1+ macrophages (M2 macrophages) to at least 1.5, 2, 3, 4, 5, 10, or higher,
f) the number of intra-tumoral NK cells to at least 140% or 200%,
g) the number of intra-tumoral CD3+ T cells to at least 150%, 200%, 300% or 400%,
h) the number of intra-tumoral B cells at least by a factor of 2, 5, 10, 20, 30 or 40, i) the number of intra-tumoral CD45+ T cells to at least 150%, 200% or 300%, and/or
j) the number of intra-tumoral CD4+ T cells to at least 150%, 200%, 300% or 400%,
preferably wherein the tumor is characterized by tumor infiltrating lymphocytes, such as tumor infiltrating T cells.

In preferred embodiments of all aspects, the antibody or antigen-binding fragment induces formation of tertiary lymphoid structures.

In preferred embodiments of all aspects, the antibody is an IgG antibody, preferably a human IgG1 or a murine IgG2a.

In preferred embodiments of all aspects, the antibody or antigen-binding fragment binds with an EC50 of <15 nM, <10 nM, <5 nM, <1 nM or <0.6 nM
a) to human CCR8 or to an isolated polypeptide according to SEQ ID NO:46, wherein at least two or all of Y3, Y15 and Y17 have been sulfated, and/or
b) to cynomolgus CCR8 or to an isolated polypeptide according to SEQ ID NO:47, wherein at least two or all of Y3, Y15 and Y17 have been sulfated, and/or
c) to murine CCR8 or to an isolated polypeptide according to SEQ ID NO:48, wherein at least two or all of Y3, Y14 and Y15 have been sulfated.

In preferred embodiments of all aspects, the EC50 of the antibody or antigen-binding fragment for binding to human CCR8 or to an isolated polypeptide according to SEQ ID NO:46, wherein at least two or all of Y3, Y15 and Y17 have been sulfated, is below 10 nM, 5 nM, 2.5 nM, 1 nM, 0.5 nM or 0.25 nM and the EC50 of the antibody or antigen-binding fragment for binding to cynomolgus CCR8 or to an isolated polypeptide according to SEQ ID NO:47, wherein at least two or all of Y3, Y15 and Y17 have been sulfated, is below 10 nM, 5 nM, 2.5 nM, 1 nM, 0.5 nM or 0.25 nM.

In preferred embodiments of all aspects, the isolated antibody or antigen-binding fragment binds with an EC50 of <50 nM, <25 nM, <15 nM or <10 nM to activated human regulatory T cells.

In preferred embodiments of all aspects, the dissociation constant of the antibody for binding the first isolated non-sulfated polypeptide is higher than 100 nM, 150 nM, 200 nM, 250 nM, 300 nM, 350 nM, 400 nM, 450 nM, 500 nM, 600 nM, 700 nM, 800 nM, 900 nM, 1 μM, 1.25 μM, 1.5 μM, 1.75 μM, 2 μM, 2.25 μM, 2.5 μM, 2.75 μM, or 3 μM, or is not detectable. Preferably, the dissociation constant of the antibody for binding the first isolated non-sulfated polypeptide is higher than 100 nM, 250 nM, 500 nM, 1 μM, 2 μM or 3 μM, or is not detectable.

Most Preferred Combinations of "all Aspects"

Provided according to a preferred embodiment I is an isolated antibody or antigen-binding fragment thereof specifically binding to CCR8, wherein the antibody or antigen-binding fragment is non-internalizing or is characterized by an internalization into a cell with endogenous target expression which is lower than the 1.5, 2, 3, 4, 5, 6, 7, or 10-fold of the internalization of the isotype control.

Provided according to a preferred embodiment II is an isolated antibody or antigen-binding fragment thereof, specifically binding to CCR8, wherein the antibody or fragment is characterized by a HCDR3 region comprising between 10 and 34% of tyrosine and/or between 2 and 20% of histidine.

Provided according to a preferred embodiment III is an isolated antibody or antigen-binding fragment thereof specifically binding to CCR8, wherein the antibody comprises human derived CDRs.

Provided according to a preferred embodiment IV is an isolated antibody or antigen-binding fragment thereof specifically binding to CCR8, wherein the antibody or antigen-binding fragment is cross reactive for CCR8 from at least two species, preferably selected from human, cynomolgus and mouse, most preferably wherein the antibody or antigen-binding fragment is cross reactive for human and cynomolgus CCR8.

Provided according to a preferred embodiment V is an isolated antibody or antigen-binding fragment thereof, specifically binding to CCR8, wherein the antibody or antigen-binding fragment,
a. does not block CCL1 induced β-arrestin signaling and/or
b. does not induce ERK1/2 phosphorylation and/or
c. does not induce AKT phosphorylation.

Provided according to a preferred embodiment VI is an isolated antibody or antigen-binding fragment thereof specifically binding to CCR8, wherein the antibody or antigen-binding fragment is afucosylated and
a. induces antibody-dependent cell-mediated cytotoxicity (ADCC) in target cells expressing human CCR8 via human effector cells, such as human NK cells, and
b. induces antibody-dependent cell-mediated phagocytosis (ADCP) in target cells expressing human CCR8 via human effector cells, such as human macrophages,
c. wherein the maximal ADCC and ADCP induced in vitro depletion of target cells expressing human CCR8 is at least 30%, 35%, 40%, 45%, 50%, 55%, 60%, 70%, 80%, 90%, 95% or 99%.

Provided according to a preferred embodiment VII is the isolated antibody or antigen-binding fragment according to any of preferred embodiments II to VI, wherein the antibody or antigen-binding fragment is non-internalizing or is characterized by an internalization into a cell with endogenous target expression which is lower than the 1.5, 2, 3, 4, 5, 6, 7, or 10-fold of the internalization of the isotype control.

Provided according to a preferred embodiment VIII is the isolated antibody or antigen-binding fragment according to any of preferred embodiments I, or III to VII, wherein the antibody or antigen-binding fragment is characterized by a HCDR3 region comprising between 10 and 34% of tyrosine and/or between 2 and 20% of histidine.

Provided according to a preferred embodiment IX is the isolated antibody or antigen-binding fragment according to any of preferred embodiments I to II, or IV to VIII, wherein the antibody comprises human derived CDRs.

Provided according to a preferred embodiment X is the isolated antibody or antigen-binding fragment according to any of preferred embodiments I to III, or V to IX, wherein the antibody or antigen-binding fragment is cross reactive for CCR8 from at least two species, preferably selected from human, cynomolgus and mouse, most preferably wherein the antibody or antigen-binding fragment is cross reactive for human and cynomolgus CCR8.

Provided according to a preferred embodiment XI is the isolated antibody or antigen-binding fragment according to any of preferred embodiments I to X, wherein the antibody or antigen-binding fragment binds the CCR8 from a first species with a first dissociation constant KD and binds the CCR8 from a second species with a second dissociation constant KD, wherein the first and the second dissociation constant are in the same order of magnitude.

Provided according to a preferred embodiment XII is the isolated antibody or antigen-binding fragment according to any of preferred embodiments I to IV, or VI to XI, wherein the antibody or antigen-binding fragment,
a. does not block CCL1 induced β-arrestin signaling and/or b. does not induce ERK1/2 phosphorylation and/or
c. does not induce AKT phosphorylation.

Provided according to a preferred embodiment XIII is the isolated antibody or antigen-binding fragment according to any of preferred embodiments I to V, or VII to XII, wherein the antibody or antigen-binding fragment
a. induces antibody-dependent cell-mediated cytotoxicity (ADCC) in target cells expressing human CCR8 via human effector cells, such as human NK cells, and
b. induces antibody-dependent cell-mediated phagocytosis (ADCP) in target cells expressing human CCR8 via human effector cells, such as human macrophages, and optionally
c. wherein the maximal ADCC and ADCP induced in vitro depletion of target cells expressing human CCR8 is at least 30%, 35%, 40%, 45%, 50%, 55%, 60%, 70%, 80%, 90%, 95% or 99%.

Provided according to a preferred embodiment XIV is the isolated antibody or antigen-binding fragment according to any of preferred embodiments I to XIII, wherein the antibody or antigen-binding fragment specifically binds to the sulfated tyrosine rich domain of CCR8.

Provided according to a preferred embodiment XV is the isolated antibody or antigen-binding fragment according to any of preferred embodiments I to XIV, wherein the antibody or antigen-binding fragment specifically binds (i) with an EC50 of <15 nM, <10 nM, <5 nM, <1 nM or <0.6 nM
a. to human CCR8 and/or to an isolated polypeptide according to SEQ ID NO:46, wherein at least two or all of Y3, Y15 and Y17 have been sulfated, and/or
b. to cynomolgus CCR8 and/or to an isolated polypeptide according to SEQ ID NO:47, wherein at least two or all of Y3, Y15 and Y17 have been sulfated, and/or
c. to murine CCR8 and/or to an isolated polypeptide according to SEQ ID NO:48, wherein at least two or all of Y3, Y14 and Y15 have been sulfated,
and/or (ii) with an EC50 of <50 nM, <25 nM, <15 nM or <10 nM to activated human regulatory T cells.

Provided according to a preferred embodiment XVI is the isolated antibody or antigen-binding fragment thereof according to any of preferred embodiments I to XV,
a. wherein the antibody or antigen-binding fragment binds to human Fc gamma receptor IIIA variant V176 (CD16a) with a dissociation constant (KD) lower than 530 nM, 500 nM, 450 nM, 400 nM, 300 nM or 200 nM, and/or
b. wherein the antibody or antigen-binding fragment binds to human Fc gamma RITA (CD32a) with a dissociation constant (KD) lower than 30 µM, 20 µM, 10 µM, 5 µM or 1 µM.

Provided according to a preferred embodiment XVII is the isolated antibody or antigen-binding fragment thereof according to any of preferred embodiments I to XVI, wherein the antibody or antigen-binding fragment is afucosylated.

Provided according to a preferred embodiment XVIII is the isolated antibody or antigen-binding fragment thereof according to any of preferred embodiments I to XVII, wherein the antibody or antigen-binding fragment
a. induces antibody-dependent cell-mediated cytotoxicity (ADCC) in target cells expressing human CCR8 via human effector cells, such as human NK cells, and/or
b. induces antibody-dependent cell-mediated phagocytosis (ADCP) in target cells expressing human CCR8 via human effector cells, such as human macrophages,
preferably, wherein
c. the ADCC-induced maximal depletion of activated human regulatory T cells is at least 25%, 30%, 35%, 40%, 45%, 50%, 55%, 60%, 70%, 80%, 90%, 95%, 98% or 99%, and/or
d. the ADCP-induced maximal depletion of activated human regulatory T cells is at least 5%, 10%, 15%, 20%, 25%, 30%, 40% or 50%, and/or
e. the maximal ADCC and ADCP induced in vitro depletion of activated human regulatory T cells is at least 30%, 35%, 40%, 45%, 50%, 55%, 60%, 70%, 80%, 90%, 95% or 99%.

Provided according to a preferred embodiment XIX is the isolated antibody or antigen-binding fragment according to any of preferred embodiments I to XVIII, wherein
a. the EC50 of the antibody or antigen-binding fragment for ADCC-induced depletion of activated human regulatory T cells is below 100 pM, 50 pM, 25 pM, 12.5 pM, 10 M or 5 pM and/or
b. the EC50 of the antibody or antigen-binding fragment for ADCP-induced depletion of activated human regulatory T cells is below 500 pM, 250 pM, 200 pM, 150 pM, 100 pM, 75 pM, 50 pM or 25 pM.

Provided according to a preferred embodiment XX is the isolated antibody or antigen-binding fragment according to any previous preferred embodiment, wherein an effective dose of the antibody or antigen-binding fragment
a. decreases the number of activated or intra-tumoral regulatory T cells, in vitro or in a subject, to less than 50%, 40%, 30%, 25%, 20%, 10%, 5% or 1% and/or
b. increases the ratio of intra-tumoral CD8+ T cells to intra-tumoral Tregs, in vitro or in a subject, to at least 5, 10, 15, 20, 25, 30, 40, 50, 60, 70, 80, 90, 100, 150, 200, or higher and/or
c. decreases the percentage of regulatory T cells of intra-tumoral CD4+ T cells, in vitro or in a subject, to <30%, <20%, <10% or <5%.

Provided according to a preferred embodiment XXI is the isolated antibody or antigen-binding fragment according to any previous preferred embodiment, wherein an effective dose of the antibody or antigen-binding fragment induces formation of tertiary lymphoid structures in a tumor.

Provided according to a preferred embodiment XXII is the isolated antibody or antigen-binding fragment thereof according to any previous preferred embodiment, wherein the antibody is an IgG antibody, preferably a human IgG1 or a murine IgG2a, and or wherein the antigen-binding fragment is an scFv, Fab, Fab' or a F(ab')2 fragment.

Provided according to a preferred embodiment XXIII is a conjugate comprising an antibody or antigen-binding fragment according to any of preferred embodiments I to XXII, preferably wherein the conjugate comprises
a. a radioactive element,
b. a cytotoxic agent, such as an auristatin, a maytansinoid, a kinesin-spindle protein inhibitor, a nicotinamide phosphoribosyltransferase inhibitor or a pyrrolobenzodiazepine derivative,
c. a further antibody or antigen-binding fragment, or
d. a chimeric antigen receptor.

Provided according to a preferred embodiment XXIV is a pharmaceutical composition comprising an antibody or antigen-binding fragment according to any of preferred embodiments I to XXII or a conjugate according to preferred embodiment XXIII.

Provided according to a preferred embodiment XXV is the pharmaceutical composition according to preferred embodiment XXIV, comprising one or more further therapeutically active compounds, preferably selected from a. an antibody or compound targeting a checkpoint protein, such as PD1, PD-L1 or CTLA-4, preferably wherein the antibody or compound targeting the checkpoint protein is Nivolumab, Pembrolizumab, Atezolizumab, Avelumab, Durvalumab, Cemiplimab, Dostarlimab or Ipilimumab,
b. an antibody targeting a further chemokine receptor, such as CCR1, CCR2, CCR3, CCR4, CCR5, CCR6, CCR7, CCR9, CCR10, CXCR1, CXCR2, CXCR3, CXCR4, CXCR5, CXCR6, CX3CR1 or CXCR1,
c. an antibody or a small molecule targeting HER2 and/or EGFR,
d. the standard of care for any of head and neck cancer, breast cancer, gastric cancer, lung cancer, squamous cell carcinoma and esophageal tumor, melanoma, bladder cancer, liver cancer, and/or prostate cancer,
e. a chemotherapeutic agent, preferably a taxane, paclitaxel, doxorubicin, cis-platin, carboplatin, oxaliplatin, or gemcitabine,
e. a B cell depleting agent, such as an anti-CD19 antibody or an anti-CD20 antibody and/or
f. a targeted kinase inhibitor, such as Sorafinib, Regorafenib, or MEKi-1.

Provided according to a preferred embodiment XXVI is an antibody or antigen-binding fragment according to any of preferred embodiments I to XXII or a conjugate according to preferred embodiment XXIII or a pharmaceutical composition according to preferred embodiment XXIV or XXV for use as a medicament.

Provided according to a preferred embodiment XXVII is the antibody or antigen-binding fragment according to any of preferred embodiments I to XXII or a conjugate according to preferred embodiment XXIII or a pharmaceutical composition according to preferred embodiment XXIV or XXV for use in the treatment of a tumor or a disease characterized by CCR8 positive cells, such as CCR8 positive regulatory T cells.

Provided according to a preferred embodiment XXVIII is an antibody or antigen-binding fragment according to any of preferred embodiments I to XXII or a conjugate according to preferred embodiment XXIII or a pharmaceutical composition according to preferred embodiment XXIV or XXV for use in simultaneous, separate, or sequential combination
(i) with one or more further therapeutically active compounds, preferably selected from
a. an antibody or a small molecule targeting a checkpoint protein, such as PD1, PD-L1 or CTLA-4, preferably wherein the antibody or small molecule targeting a checkpoint protein is Nivolumab, Pembrolizumab, Atezolizumab, Avelumab, Durvalumab, Cemiplimab, Dostarlimab or Ipilimumab,
b. an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
c. an antibody targeting a protein which is specifically expressed by the tumor cells,
d. an antibody or a small molecule targeting HER2 and/or EGFR,
e. the standard of care for any of head and neck cancer, breast cancer, gastric cancer, lung cancer, squamous cell carcinoma, esophageal tumor, melanoma, bladder cancer, liver cancer, and/or prostate cancer,
f. a chemotherapeutic agent, preferably a taxane, paclitaxel, doxorubicin, cis-platin, carboplatin, oxaliplatin, or gemcitabine and/or
g. a targeted kinase inhibitor, such as Sorafinib, Regorafenib, or MEKi-1, and/or (ii) with radiation therapy, and/or (iii) with depletion of intra-tumoral B cells, in the treatment of a tumor or a disease characterized by CCR8 positive cells, such as CCR8 positive regulatory T cells.

Provided according to a preferred embodiment XXIX is the antibody, fragment, conjugate or pharmaceutical composition for use according to preferred embodiment XXVII or XXVIII, wherein the tumor is selected from the group of T-cell acute lymphoblastic leukemia, breast cancer, triple-negative breast cancer, triple positive breast cancer, non-small cell lung cancer (NSCLC), small cell lung cancer (SCLC), testicular cancer, gastric cancer, head and neck squamous cell carcinoma, thymoma, esophageal adenocarcinoma, colorectal cancer, pancreatic adenocarcinoma, ovarian cancer or cervical cancer, acute myeloid leukemia, kidney cancer, bladder cancer, skin cancer, melanoma, thyroid cancer, mesothelioma, sarcoma and prostate cancer, B cell lymphoma, T cell lymphoma, or any other cancer involving CCR8 expressing cells, preferably wherein the tumor is selected from head and neck cancer, breast cancer, gastric cancer, lung cancer, squamous cell carcinoma, esophageal tumor, melanoma, bladder cancer, liver cancer, prostate cancer, B cell lymphoma and T cell lymphoma.

Provided according to a preferred embodiment XXX is the antibody, fragment, conjugate or pharmaceutical composition for use according to preferred embodiment XXVI to XXIX, wherein the use comprises determining
a. presence or quantity of tumor infiltrating lymphocytes,
b. presence or quantity of macrophages and/or NK cells,
c. presence or quantity of CCR8 positive or FOXP3 positive regulatory T cells,
d. tumor mutational burden,
e. cancer staging,
f. presence, level or activation of interferon-stimulated genes or proteins,
g. CCR8 expression,
h. presence or quantity of complement factor proteins, serpins, and/or MHC components,
i. presence or quantity of cytokines, such as inflammatory or suppressive cytokines,
j. activation of immune gene expression, and/or
k. immune checkpoint (protein) expression, such as PD-(L)1 or CTLA4 expression,
l. presence or quantity of tumor infiltrating CD19+ B cells,
m. presence or quantity of tumor infiltrating CD8+ T cells;
to predict or monitor treatment success.

Provided according to a preferred embodiment XXXI is a polynucleotide encoding an antibody or antigen-binding fragment according to any of preferred embodiments I to XXII.

Provided according to a preferred embodiment XXXII is a vector comprising a polynucleotide according to preferred embodiment XXXI.

Provided according to a preferred embodiment XXXIII is an isolated cell arranged for production of an antibody or antigen-binding fragment according to any of preferred embodiments I to XXII.

Provided according to a preferred embodiment XXXIV is a method of producing an antibody or antigen-binding fragment according to any of preferred embodiments I to XXII or a conjugate according to preferred embodiment XXIII, comprising culturing a cell according to preferred embodiment XXXIII and optionally purification of the antibody or antigen-binding fragment.

Provided according to a preferred embodiment XXXV is the antibody or antigen-binding fragment according to any of preferred embodiments I to XXII or a conjugate according to preferred embodiment XXIII for use as a diagnostic agent in vivo or in vitro.

Provided according to a preferred embodiment XXXVI is kit comprising an antibody or antigen-binding fragment according to any of preferred embodiments I to XXII or a conjugate according to preferred embodiment XXIII or a pharmaceutical composition according to preferred embodiment XXIV or XXV with instructions for use.

Aspect 19—Antibody Conjugates

In addition to naked antibodies, various further antibody- or antibody fragment-based conjugates can be designed using the antibodies or antigen binding fragments disclosed herein. These conjugates may be conjugates for diagnosis, therapy, research applications, and various other purposes. Provided are for example antibodies or antigen binding fragments thereof conjugated to radionuclides, cytotoxic agents, organic compounds, protein toxins, immunomodulators such as cytokines, fluorescent moieties, cells, further antibodies or antigen binding fragments thereof.

The conjugates disclosed herein, e.g. antibody drug conjugates (ADCs), targeted thorium conjugates (TTCs), bispecific antibodies etc., are "modular" in nature. Throughout the disclosure, various specific embodiments of the various "modules" composing the conjugates are described. As specific non-limiting examples, specific embodiments of antibodies or fragments thereof, linkers, and cytotoxic and/or cytostatic agents that may compose the ADCs are described. It is intended that all of the specific embodiments described may be combined with each other as though each specific combination was explicitly described individually.

According to a $19^{th}$ aspect, there is provided a conjugate comprising an antibody or antigen-binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect or a combination thereof. For example, the conjugate comprises an antibody or antigen-binding fragment according to the $6^{th}$ aspect. For example, the conjugate comprises an antibody or antigen-binding fragment according to the $7^{th}$ aspect. For example, the conjugate comprises an antibody or antigen-binding fragment according to the $8^{th}$ aspect. For example, the conjugate comprises an antibody or antigen-binding fragment according to the $9^{th}$ aspect. For example, the conjugate comprises an antibody or antigen-binding fragment according to the $10^{th}$ aspect. For example, the conjugate comprises an antibody or antigen-binding fragment according to the $11^{th}$ aspect. For example, the conjugate comprises an antibody or antigen-binding fragment according to the $12^{th}$ aspect. For example, the conjugate comprises an antibody or antigen-binding fragment according to the $13^{th}$ aspect. For example, the conjugate comprises an antibody or antigen-binding fragment according to the $14^{th}$ aspect. For example, the conjugate comprises an antibody or antigen-binding fragment according to the $15^{th}$ aspect. For example, the conjugate comprises an antibody or antigen-binding fragment according to the $16^{th}$ aspect. For example, the conjugate comprises an antibody or antigen-binding fragment according to the $17^{th}$ aspect. For example, the conjugate comprises an antibody or antigen-binding fragment according to the $18^{th}$ aspect.

According to some preferred embodiments the conjugate comprises (a) a radioactive element, (b) a cytotoxic agent, such as an auristatin, a maytansinoid, a kinesin-spindle protein (KSP) inhibitor, a nicotinamide phosphoribosyltransferase (NAMPT) inhibitor or a pyrrolobenzodiazepine derivative, (c) a further antibody or antigen-binding fragment, (d) a chimeric antigen receptor.

Radioconjugates

According to some first embodiments of the 19th aspect, the conjugate comprises or is arranged to comprise a radionuclide, such as a beta particle, an alpha particle, or an Auger electron emitter. Suitable beta emitters according to the current invention are for example yttrium-90, iodine-131, strontium-89-chloride, lutetium-177, holmium-166, rhenium-186, rhenium-188, copper-67, promethium-149, gold-199, and rhodium-105. Suitable Auger electron emitters, according to the current invention are for example bromine-77, indium-111, iodine-123, and iodine-125. Suitable alpha emitters, according to the current invention are for example thorium-227, bismuth-213, radium-223, actinium-225 and astatine-211.

For example, thorium-227 (227Th) can be efficiently complexed with octadentate 3,2-hydroxypyridinone (3,2-HOPO) chelators that are conjugated to antibodies according to the current invention, resulting in highly stable targeted thorium-227 conjugates (TTCs), as described in example 13. Targeted thorium conjugates (TTCs) comprise three main building blocks. Following the β-particle decay of actinium-227, the first building block, α-particle-emitting radionuclide 227Th is purified by ion exchange chromatography. The second building block is a chelator, such as a siderophore-derived chelator containing HOPO groups bearing four 3-hydroxy-N-methyl-2-pyridinone moieties on a symmetrical polyamine scaffold functionalized with a carboxylic acid linker for bioconjugation. Conjugation to a targeting moiety can be achieved through the amide bond formation with the ε-amino groups of lysine residues. These octadentate 3,2-HOPO chelators can be efficiently labeled with 227Th, with high yield, purity, and stability at ambient conditions. Compared with the tetra-azacyclododecane-1,4, 7,10-tetraacetic acid (DOTA) chelator, which often requires heating, the HOPO chelators are superior due to efficient radiolabeling at ambient temperatures and high stability of formed complexes. The third building block is the targeting moiety, that is the chemokine receptor antibody or antigen binding fragment thereof according to any of the aspects 6, 7, 8, 9, 10, 11, 12, 13, 14, 15, 16, 17 or 18.

ADCs

According to some second embodiments of the 19th aspect, the conjugate comprises a cytotoxic agent, e.g. to form an antibody drug conjugate (ADC).

In some preferred embodiments, the cytotoxic agent is an auristatin, a maytansinoid, a kinesin-spindle protein (KSP) inhibitor, a nicotinamide phosphoribosyltransferase (NAMPT) inhibitor or a pyrrolobenzodiazepine derivative. Generation of conjugates comprising maytansinoid may occur as described in Chari, Ravi V J, et al. "Immunoconjugates containing novel maytansinoids: promising anticancer drugs." Cancer research 52.1 (1992): 127-131, or EP2424569 B1, both incorporated herein in their entirety. Generation of conjugates comprising kinesin-spindle protein (KSP) inhibitors may occur as described in WO2019243159 A1, incorporated herein in its entirety. Generation of conjugates comprising a nicotinamide phosphoribosyltransferase (NAMPT) inhibitor may occur as described in WO2019149637 A1, incorporated herein in its entirety. Generation of conjugates comprising a pyrrolobenzodiazepine may be obtained as described in EP3355935 A1, incorporated herein in its entirety.

The cytotoxic and/or cytostatic agent of the anti-chemokine receptor or anti-CCR8 ADC may be any agent known to inhibit the growth and/or replication of, and/or kill cells. Numerous agents having cytotoxic and/or cytostatic properties are known in the literature. Non-limiting examples of classes of cytotoxic and/or cytostatic agents include, by way of example and not limitation, cell cycle modulators, apoptosis regulators, kinase inhibitors, protein synthesis inhibitors, alkylating agents, DNA cross-linking agents, intercalating agents, mitochondria inhibitors, nuclear export inhibitors, topoisomerase I inhibitors, topoisomerase II inhibitors, RNA/DNA antimetabolites and antimitotic agents.

The linkers linking the cytotoxic and/or cytostatic agent(s) to the antigen binding moiety of an anti-chemokine receptor or anti-CCR8 ADC may be long, short, flexible, rigid, hydrophilic or hydrophobic in nature, or may comprise segments that have different characteristics, such as segments of flexibility, segments of rigidity, etc. The linker may be chemically stable to extracellular environments, for example, chemically stable in the blood stream, or may include linkages that are not stable and release the cytotoxic and/or cytostatic agents in the extracellular milieu. In some embodiments, the linkers include linkages that are designed to release the cytotoxic and/or cytostatic agents upon internalization of the anti-chemokine receptor or anti-CCR8 ADC, within the cell. In some specific embodiments, the linkers include linkages designed to cleave and/or immolate or otherwise breakdown specifically or non-specifically inside cells. A wide variety of linkers useful for linking drugs to antigen binding moieties such as antibodies in the context of ADCs are known in the art. Any of these linkers, as well as other linkers, may be used to link the cytotoxic and/or cytostatic agents to the antigen binding moiety of the anti-chemokine receptor or anti-CCR8 ADCs, described herein.

The number of cytotoxic and/or cytostatic agents linked to the antigen binding moiety of an anti-chemokine receptor or anti-CCR8 ADC (drug-to-antibody ratio: DAR) can vary and will be limited only by the number of available attachments sites on the antigen binding moiety and the number of agents linked to a single linker. Typically, a linker will link a single cytotoxic and/or cytostatic agent to the antigen binding moiety of an anti-chemokine receptor or anti-CCR8 ADC. In embodiments of anti-chemokine receptor or anti-CCR8 ADCs, which include more than a single cytotoxic and/or cytostatic agent, each agent may be the same or different. As long as the anti-chemokine receptor or anti-CCR8 ADC, does not exhibit unacceptable levels of aggregation under the conditions of use and/or storage, anti-chemokine receptor or anti-CCR8 ADCs, with DARs of twenty, or even higher, are contemplated. In some embodiments, the anti-chemokine receptor or anti-CCR8 ADCs, described herein may have a DAR in the range of about 1-10, 1-8, 1-6, or 1-4. In certain specific embodiments, the anti-chemokine receptor or anti-CCR8 ADC may have a DAR of 2, 3 or 4. In some embodiments, the anti-chemokine receptor or anti-CCR8 ADCs, are compounds according to structural formula (I):

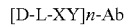

(I)

or salts thereof, where each "D" represents, independently of the others, a cytotoxic and/or cytostatic agent; each "L" represents, independently of the others, a linker; "Ab" represents an anti-chemokine receptor binding moiety, e.g. an anti-CCR8 antibody according to the current invention; each "XY" represents a linkage formed between a functional group Rx on the linker and a "complementary" functional group Ry on the anti-chemokine receptor binding moiety; and n represents the DAR of the anti-chemokine receptor ADC.

In a specific exemplary embodiment, the anti-chemokine receptor ADCs are compounds according to structural formula (I) in which each "D" is the same and is either a cell-permeating auristatin (for example, dolastatin-10 or MMAE) or a cell-permeating minor groove-binding DNA cross-linking agent; each "L" is the same and is a linker cleavable by a lysosomal enzyme; each "XY" is a linkage formed between a maleimide and a sulfhydryl group; "Ab" is an antibody or fragment thereof comprising six CDRs corresponding to the six CDRs of an anti-chemokine receptor or CCR8 antibody according to the current invention; and n is 2, 3 or 4. In a specific embodiment "Ab" is a fully human antibody comprising human derived CDRs.

Cytotoxic and cytostatic agents are agents known to inhibit the growth and/or replication of and/or kill cells and in particular tumor cells or intra-tumoral Treg cells. These compounds may be used in a combination therapy with an anti-chemokine receptor antibody such as a CCR8 antibody, or as part of an anti-chemokine receptor ADC as described herein: In some embodiments, the drug moiety of the anti-chemokine receptor or anti-CCR8 ADC is a cytostatic agent selected from radionuclides, alkylating agents, DNA cross-linking agents, DNA intercalating agents (e.g., groove binding agents such as minor groove binders), cell cycle modulators, apoptosis regulators, kinase inhibitors, protein synthesis inhibitors, mitochondria inhibitors, nuclear export inhibitors, topoisomerase I inhibitors, topoisomerase II inhibitors, RNA/DNA antimetabolites and antimitotic agents. In some embodiments, the drug moiety of the anti-chemokine receptor or anti-CCR8 ADC is an alkylating agent selected from asaley (L-Leucine, N—[N-acetyl-4-[bis-(2-chloroethyl)amino]-DL-phenylalanyl]-, ethylester); AZQ (1,4-cyclohexadiene-1,4-dicarbamic acid, 2, 5-bis(1-aziridinyl)-3,6-dioxo-, diethyl ester); BCNU (N,N'-Bis(2-chloroethyl)-N-nitrosourea); busulfan (1,4-butanediol dimethanesulfonate); (carboxyphthalato)platinum; CBDCA (cis-(1,1-cyclobutanedicarboxylato)diammineplatinum(II))); CCNU (N-(2-chloroethyl)-N'-cyclohexyl-N-nitrosourea); CHIP (iproplatin; NSC 256927); chlorambucil; chlorozotocin (2-[[[(2-chloroethyl) nitrosoamino]carbonyl]amino]-2-deoxy-D-glucopyranose); cis-platinum (cisplatin); clomesone; cyanomorpholinodoxorubicin; cyclodisone; dianhydrogalactitol (5,6-diepoxydulcitol); fluorodopan ((5-[(2-chloroethyl)-(2-fluoroethy)amino]-6-methyl-uracil); hepsulfam; hycanthone; indolinobenzodiazepine dimer DGN462; melphalan; methyl CCNU ((1-(2-chloroethyl)-3-(trans-4-methylcyclohexane)-1-nitrosourea); mitomycin C; mitozolamide; nitrogen mustard ((bis(2-chloroethyl) methylamine hydrochloride); PCNU ((1-(2-chloroethyl)-3-(2,6-dioxo-3-piperidyl)-1-nitrosourea)); piperazine alkylator ((1-(2-chloroethyl)-4-(3-chloropropyl)-piperazine dihydrochloride)); piperazinedione; pipobroman (N,N'-bis (3-bromopropionyl) piperazine); porfiromycin (N-methyl-mitomycin C); spirohydantoin mustard; teroxirone (triglycidylisocyanurate); tetraplatin; thio-tepa (N,N',N"-tri-1,2-ethanediylthio phosphoramide); triethylenemelamine; uracil nitrogen mustard (desmethyldopan); Yoshi-864 ((bis(3-mesyloxy propyl)amine hydrochloride).

In some embodiments, the drug moiety of the anti-chemokine receptor or anti-CCR8 ADC is a DNA alkylating-like agent selected from Cisplatin; Carboplatin; Nedaplatin;

Oxaliplatin; Satraplatin; Triplatin tetranitrate; Procarbazine; altretamine; dacarbazine; mitozolomide; temozolomide.

In some embodiments, the drug moiety of the anti-chemokine receptor or anti-CCR8 ADC is an alkylating antineoplastic agents selected from Carboquone; Carmustine; Chlornaphazine; Chlorozotocin; Duocarmycin; Evofosfamide; Fotemustine; Glufosfamide; Lomustine; Mannosulfan; Nimustine; Phenanthriplatin; Pipobroman; Ranimustine; Semustine; Streptozotocin; ThioTEPA; Treosulfan; Triaziquone; Triethylenemelamine; Triplatin tetranitrate.

In some embodiments, the drug moiety of the anti-chemokine receptor or anti-CCR8 ADC is a DNA replication and repair inhibitor selected from Altretamine; Bleomycin; Dacarbazine; Dactinomycin; Mitobronitol; Mitomycin; Pingyangmycin; Plicamycin; Procarbazine; Temozolomide; ABT-888 (veliparib); olaparib; KU-59436; AZD-2281; AG-014699; BSI-201; BGP-15; INO-1001; ONO-2231.

In some embodiments, the drug moiety of the anti-chemokine receptor or anti-CCR8 ADC is a cell cycle modulator, such as Paclitaxel; Nab-Paclitaxel; Docetaxel; Vincristine; Vinblastine; ABT-348; AZD-1152; MLN-8054; VX-680; Aurora A-specific kinase inhibitors; Aurora B-specific kinase inhibitors and pan-Aurora kinase inhibitors; AZD-5438; BMI-1040; BMS-032; BMS-387; CVT-2584; flavopyridol; GPC-286199; MCS-5A; PD0332991; PHA-690509; seliciclib (CYC-202, R-roscovitine); ZK-304709; AZD4877, ARRY-520: GSK923295A.

In some embodiments, the drug moiety of the anti-chemokine receptor or anti-CCR8 ADC is an apoptosis regulator such as AT-101 ((−)gossypol); G3139 or oblimersen (Bcl-2-targeting antisense oligonucleotide); IPI-194; IPI-565; N-(4-(4-((4'-chloro(1,1'-biphenyl)-2-yl)methyl)piperazin-1-ylbenzoyl)-4-(((1R)-3-(dimethylamino)-1-((phenylsulfanyl)methyl)propyl)amino)-3-nitrobenzenesulfonamide); N-(4-(4-((2-(4-chlorophenyl)-5,5-dimethyl-1-cyclohex-1-en-1-yl)methyl)piperazin-1-yl)benzoyl)-4-(((1R)-3-(morpholin-4-yl)-1-((phenylsulfanyl)methyl)propyl)amino)-3-((trifluoromethyl)sulfonyl)benzenesulfonamide; GX-070 (Obatoclax®; 1H-Indole, 2-(2-((3,5-dimethyl-1H-pyrrol-2-yl)methylene)-3-methoxy-2H-pyrrol-5-yl)-)); HGS1029; GDC-0145; GDC-0152; LCL-161; LBW-242; venetoclax; agents that target TRAIL or death receptors (e.g., DR4 and DR5) such as ETR2-ST01, GDC0145, HGS-1029, LBY-135, PRO-1762; drugs that target caspases, caspase-regulators, BCL-2 family members, death domain proteins, TNF family members, Toll family members, and/or NF-kappa-B proteins.

In some embodiments, the drug moiety of the anti-chemokine receptor or anti-CCR8 ADC is an angiogenesis inhibitor such as ABT-869; AEE-788; axitinib (AG-13736); AZD-2171; CP-547,632; IM-862; pegaptamib; sorafenib; BAY43-9006; pazopanib (GW-786034); vatalanib (PTK-787, ZK-222584); sunitinib; SU-11248; VEGF trap; vandetanib; ABT-165; ZD-6474; DLL4 inhibitors.

In some embodiments, the drug moiety of the anti-chemokine receptor or anti-CCR8 ADC is a proteasome inhibitor such as Bortezomib; Carfilzomib; Epoxomicin; Ixazomib; Salinosporamide A.

In some embodiments, the drug moiety of the anti-chemokine receptor or anti-CCR8 ADC is a kinase inhibitor such as Afatinib; Axitinib; Bosutinib; Crizotinib; Dasatinib; Erlotinib; Fostamatinib; Gefitinib; Ibrutinib; Imatinib; Lapatinib; Lenvatinib; Mubritinib; Nilotinib; Pazopanib; Pegaptanib; Sorafenib; Sunitinib; SU6656; Vandetanib; Vemurafenib; CEP-701 (lesaurtinib); XL019; INCB018424 (ruxolitinib); ARRY-142886 (selemetinib); ARRY-438162 (binimetinib); PD-325901; PD-98059; AP-23573; CCI-779; everolimus; RAD-001; rapamycin; temsirolimus; ATP-competitive TORC1/TORC2 inhibitors including PI-103, PP242, PP30, Torin 1; LY294002; XL-147; CAL-120; ONC-21; AEZS-127; ETP-45658; PX-866; GDC-0941; BGT226; BEZ235; XL765.

In some embodiments, the drug moiety of the anti-chemokine receptor or anti-CCR8 ADC is a protein synthesis inhibitor such as Streptomycin; Dihydrostreptomycin; Neomycin; Framycetin; Paromomycin; Ribostamycin; Kanamycin; Amikacin; Arbekacin; Bekanamycin; Dibekacin; Tobramycin; Spectinomycin; Hygromycin B; Paromomycin; Gentamicin; Netilmicin; Sisomicin; Isepamicin; Verdamicin; Astromicin; Tetracycline; Doxycycline; Chlortetracycline; Clomocycline; Demeclocycline; Lymecycline; Meclocycline; Metacycline; Minocycline; Oxytetracycline; Penimepicycline; Rolitetracycline; Tetracycline; Glycylcyclines; Tigecycline; Oxazolidinone; Eperezolid; Linezolid; Posizolid; Radezolid; Ranbezolid; Sutezolid; Tedizolid; Peptidyl transferase inhibitors; Chloramphenicol; Azidamfenicol; Thiamphenicol; Florfenicol; Pleuromutilins; Retapamulin; Tiamulin; Valnemulin; Azithromycin; Clarithromycin; Dirithromycin; Erythromycin; Flurithromycin; Josamycin; Midecamycin; Miocamycin; Oleandomycin; Rokitamycin; Roxithromycin; Spiramycin; Troleandomycin; Tylosin; Ketolides; Telithromycin; Cethromycin; Solithromycin; Clindamycin; Lincomycin; Pirlimycin; Streptogramins; Pristinamycin; Quinupristin/dalfopristin; Virginiamycin.

In some embodiments, the drug moiety of the anti-chemokine receptor or anti-CCR8 ADC is a histone deacetylase inhibitor such as Vorinostat; Romidepsin; Chidamide; Panobinostat; Valproic acid; Belinostat; Mocetinostat; Abexinostat; Entinostat; SB939 (pracinostat); Resminostat; Givinostat; Quisinostat; thioureidobutyronitrile (Kevetrin™); CUDC-10; CHR-2845 (tefinostat); CHR-3996; 4SC-202; CG200745; ACY-1215 (rocilinostat); ME-344; sulforaphane.

In some embodiments, the drug moiety of the anti-chemokine receptor or anti-CCR8 ADC is a topoisomerase I inhibitor such as camptothecin; various camptothecin derivatives and analogs (for example, NSC 100880, NSC 603071, NSC 107124, NSC 643833, NSC 629971, NSC 295500, NSC 249910, NSC 606985, NSC 74028, NSC 176323, NSC 295501, NSC 606172, NSC 606173, NSC 610458, NSC 618939, NSC 610457, NSC 610459, NSC 606499, NSC 610456, NSC 364830, and NSC 606497); morpholinisoxorubicin; SN-38.

In some embodiments, the drug moiety of the anti-chemokine receptor or anti-CCR8 ADC is a topoisomerase II inhibitor such as doxorubicin; amonafide (benzisoquinolinedione); m-AMSA (4'-(9-acridinylamino)-3'-methoxymethanesulfonanilide); anthrapyrazole derivative ((NSC 355644); etoposide (VP-16); pyrazoloacridine ((pyrazolo[3,4,5-kl]acridine-2(6H)-propanamine, 9-methoxy-N, N-dimethyl-5-nitro-, monomethanesulfonate); bisantrene hydrochloride; daunorubicin; deoxydoxorubicin; mitoxantrone; menogaril; N,N-dibenzyl daunomycin; oxanthrazole; rubidazone; teniposide.

In some embodiments, the drug moiety of the anti-chemokine receptor or anti-CCR8 ADC is a DNA intercalating agent such as anthramycin; chicamycin A; tomaymycin; DC-81; sibiromycin; pyrrolobenzodiazepine derivative; SGD-1882 ((S)-2-(4-aminophenyl)-7-methoxy-8-(3 S)-7-methoxy-2-(4-methoxyphenyl)-5-oxo-5,11a-dihydro-1H-benzo[e]pyrrolo[1,2-a][1,4]diazepin-8-yl)oxy)propoxy)-1H-benzo[e]pyrrolo[1,2-a][1,4]diazepin-5(11aH)-one);

SG2000 (SJG-136; (11aS,11a'S)-8,8'-(propane-1,3-diylbis(oxy))bis(7-methoxy-2-methylene-2,3-dihydro-1H-benzo[e]pyrrolo[1,2-a][1,4]diazepin-5(11aH)-one)).

In some embodiments, the drug moiety of the anti-chemokine receptor or anti-CCR8 ADC is a RNA/DNA antimetabolite such as L-alanosine; 5-azacytidine; 5-fluorouracil; acivicin; aminopterin derivative N-[2-chloro-5[[(2, 4-diamino-5-methyl-6-quinazolinyl)methyl]amino]benzoyl] L-aspartic acid (NSC 132483); aminopterin derivative N-[4-[[(2, 4-diamino-5-ethyl-6-quinazolinyl)methyl]amino]benzoyl]L-aspartic acid; aminopterin derivative N-[2-chloro-4-[[(2, 4-diamino-6-pteridinyl)methyl]amino]benzoyl]L-aspartic acid monohydrate; antifolate PT523 ((Nα-(4-amino-4-deoxypteroyl)-Nγ-hemiphthaloyl-L-ornithine)); Baker's soluble antifol (NSC 139105); dichlorallyl lawsone ((2-(3, 3-dichloroallyl)-3-hydroxy-1,4-naphthoquinone); brequinar; ftorafur ((pro-drug; 5-fluoro-1-(tetrahydro-2-furyl)-uracil); 5,6-dihydro-5-azacytidine; methotrexate; methotrexate derivative (N-[[4-[[(2, 4-diamino-6-pteridinyl)methyl]methylamino]-1-naphthalenyl]carbonyl]L-glutamic acid); PALA ((N-(phosphonoacetyl)-L-aspartate); pyrazofurin; trimetrexate.

In some embodiments, the drug moiety of the anti-chemokine receptor or anti-CCR8 ADC is a DNA antimetabolite such as 3-HP; 2'-deoxy-5-fluorouridine; 5-HP; α-TGDR (α-2'-deoxy-6-thioguanosine); aphidicolin glycinate; ara C (cytosine arabinoside); 5-aza-2'-deoxycytidine; β-TGDR (β-2'-deoxy-6-thioguanosine); cyclocytidine; guanazole; hydroxyurea; inosine glycodialdehyde; macbecin II; pyrazoloimidazole; thioguanine; thiopurine.

In some embodiments, the drug moiety of the anti-chemokine receptor or anti-CCR8 ADC, is a mitochondria inhibitor such as pancratistatin; phenpanstatin; rhodamine-123; edelfosine; d-alpha-tocopherol succinate; compound 11β; aspirin; ellipticine; berberine; cerulenin; GX015-070 (Obatoclax®; 1H-Indole, 2-(2-((3,5-dimethyl-1H-pyrrol-2-yl)methylene)-3-methoxy-2H-pyrrol-5-yl)-); celastrol (tripterine); metformin; Brilliant green; ME-344.

In some embodiments, the drug moiety of the anti-chemokine receptor or anti-CCR8 ADC, is an antimitotic agent such as allocolchicine; auristatins, such as MMAE (monomethyl auristatin E) and MMAF (monomethyl auristatin F); halichondrin B; cemadotin; colchicine; cholchicine derivative (N-benzoyl-deacetyl benzamide); dolastatin-10; dolastatin-15; maytansine; maytansinoids, such as DM1 (N2'-deacetyl-N2'-(3-mercapto-1-oxopropyl)-maytansine); rhozoxin; paclitaxel; paclitaxel derivative ((2'-N-[3-(dimethylamino)propyl]glutaramate paclitaxel); docetaxel; thiocolchicine; trityl cysteine; vinblastine sulfate; vincristine sulfate.

In some embodiments, the drug moiety of the anti-chemokine receptor or anti-CCR8 ADC is a nuclear export inhibitor such as callystatin A; delactonmycin; KPT-185 (propan-2-yl (Z)-3-[3-[3-methoxy-5-(trifluoromethyl)phenyl]-1,2,4-triazol-1-yl]prop-2-enoate); kazusamycin A; leptolstatin; leptofuranin A; leptomycin B; ratjadone; Verdinexor ((Z)-3-[3-[3,5-bis(trifluoromethyl)phenyl]-1,2,4-triazol-1-yl]-N-pyridin-2-ylprop-2-enehydrazide).

In some embodiments, the drug moiety of the anti-chemokine receptor or anti-CCR8 ADC is a hormonal therapeutics such as anastrozole; exemestane; arzoxifene; bicalutamide; cetrorelix; degarelix; deslorelin; trilostane; dexamethasone; flutamide; raloxifene; fadrozole; toremifene; fulvestrant; letrozole; formestane; glucocorticoids; doxercalciferol; sevelamer carbonate; lasofoxifene; leuprolide acetate; megesterol; mifepristone; nilutamide; tamoxifen citrate; abarelix; prednisone; finasteride; rilostane; buserelin; luteinizing hormone releasing hormone (LHRH); Histrelin; trilostane or modrastane; fosrelin; goserelin.

Any of these agents that include, or that may be modified to include, a site of attachment to an antibody and/or binding fragment can be included in an anti-chemokine receptor ADC, e.g. in an anti-CCR8 ADC.

CAR T Cells

According to some third embodiments of the 19th aspect, the conjugate is a CAR T cell conjugate engineered for chemokine receptor or CCR8 targeting. Recently, CAR T cells have gained attention from their clinical successes and expedited FDA approvals, cf. WO2020102240, incorporated herein in its entirety. In the CAR T cell approach, T cells are collected from patient blood and are then genetically engineered to express CARs that are specific for an antigen present on tumor cells. These engineered T cells are then re-administered to the same patient. Upon injection, CAR T cells recognize the targeted antigen on target cells to induce target cell death. T cells expressing chimeric antigen receptors (CAR T cells) thus constitute a novel modality for medical uses such as tumor treatment. The chimeric antigen receptor (CAR) is a genetically engineered receptor that is designed to target a specific antigen, for example, a tumor antigen. This targeting can result in cytotoxicity against the tumor, for example, such that CAR T cells expressing CARs can target and kill tumors via the specific tumor antigens. According to the present invention, the antibodies or antigen binding fragments provided for CCR8 or chemokine receptor recognition can be used to engineer CAR T cells for specific recognition of CCR8 expressing cells or cells expressing the respective chemokine receptor. CARS according to the current invention may comprise a) a recognition region, e.g., a single chain fragment variable (scFv) region derived from a provided anti-CCR8 or anti-chemokine receptor antibody for recognition and binding to the CCR8 or chemokine receptor expressed by the target cell, and b) an activation signaling domain, e.g., the CD3 chain of T cells, which can serve as a T cell activation signal in CARs.

Preferably, the CARs according to the current invention comprise a co-stimulation domain (e.g., CD137, CD28 or CD134) to achieve prolonged activation of T cells in vivo. Addition of a co-stimulation domain enhances the in vivo proliferation and survival of T cells containing CARs, and initial clinical data have shown that such constructs are promising therapeutic agents in the treatment of diseases, such as cancer. According to the current invention, the CAR T cells can be used to treat any disease with local or systemic aberrant presence of cells expressing the target chemokine receptor, in particular CCR8 expressing cells, such as Treg cells.

Bispecifics

According to some fourth embodiments of the 19th aspect, the conjugate is a bispecific antibody or a multispecific antibody. In some preferred embodiments the bispecific antibody comprises at least one Fc domain.

In some preferred embodiments of the 19th aspect, the first binding moiety of the bispecific antibody is an antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect.

In some embodiments A of the fourth embodiments of the 19th aspect, the first binding moiety of the bispecific antibody is an antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect and the second binding moiety of the bispecific antibody is the same or a different antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect.

In some embodiments B of the fourth embodiments of the 19th aspect, the first binding moiety of the bispecific antibody is an antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect binding human CCR8 and the second binding moiety of the bispecific antibody is an antibody or antigen binding fragment binding to a different chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1. For example, the second binding moiety of the bispecific antibody is Mogamulizumab or an antigen binding fragment thereof.

In some embodiments C of the fourth embodiments of the 19th aspect, the first binding moiety of the bispecific antibody is an antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect, preferably binding CCR8, and the second binding moiety of the bispecific antibody is an antibody or antigen binding fragment binding to a cell-surface protein such as cell surface protein expressed on immune cells or a tissue- or cell type-specific antigen. In some of these embodiments, the second binding moiety of the bispecific antibody is an antibody or antigen binding fragment targeting a checkpoint protein, such as an anti-PD1 antibody, an anti-PD-L1 antibody, or a CTLA-4 antibody. Suitable checkpoint protein targeting antibodies include Nivolumab, Pembrolizumab, Atezolizumab, Avelumab, Durvalumab, Cemiplimab, Dostarlimab, or Ipilimumab. In some other of these embodiments, the second binding moiety of the bispecific antibody is a HER2 targeting antibody, such as Trastuzumab, Pertuzumab and/or Margetuximab.

In some embodiments D of the fourth embodiments of the 19th aspect, the first binding moiety of the bispecific antibody is an antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect, preferably binding CCR8, and the second binding moiety of the bispecific antibody is an antibody or antigen binding fragment binding to a cell surface molecule associated with T-cell activation, preferably selected from CD25, CTLA-4, PD-1, LAG3, TIGIT, ICOS, and TNF receptor super family members, 4-1BB, OX-40, and GITR.

Techniques for making bi- or multispecific antibodies include, but are not limited to, recombinant co-expression of two immunoglobulin heavy chain-light chain pairs having different specificities (see Milstein and Cuello. "Hybrid hybridomas and their use in immunohistochemistry." Nature 305.5934 (1983): 537-540.; WO1993008829 A1, and Traunecker, André, Antonio Lanzavecchia, and Klaus Karjalainen. "Bispecific single chain molecules (Janusins) target cytotoxic lymphocytes on HIV infected cells." The EMBO Journal 10.12 (1991): 3655-3659.), and chemical conjugation of two different monoclonal antibodies (see Staerz, Uwe D., Osami Kanagawa, and Michael J. Bevan. "Hybrid antibodies can target sites for attack by T cells." Nature 314.6012 (1985): 628-631.). Multispecific antibodies may also be made by cross-linking two or more antibodies or fragments (see, e.g., U.S. Pat. No. 4,676,980, and Brennan, Maureen, Peter F. Davison, and Henry Paulus. "Preparation of bispecific antibodies by chemical recombination of monoclonal immunoglobulin G1 fragments." Science 229.4708 (1985): 81-83.), using leucine zippers to produce bi-specific antibodies (see, e.g., Kostelny, Sheri A., M. S. Cole, and J. Yun Tso. "Formation of a bispecific antibody by the use of leucine zippers." The Journal of Immunology 148.5 (1992): 1547-1553.), using diabody technology for making bispecific antibody fragments (see, e.g., Holliger, Philipp, Terence Prospero, and Greg Winter. ""Diabodies": small bivalent and bispecific antibody fragments." Proceedings of the National Academy of Sciences 90.14 (1993): 6444-6448.), using single-chain Fv (sFv) dimers (see, e.g. Gruber, Meegan, et al. "Efficient tumor cell lysis mediated by a bispecific single chain antibody expressed in *Escherichia coli*." The Journal of immunology 152.11 (1994): 5368-5374.), by preparing trispecific antibodies as described (e.g., in Tutt, Alison, G. T. Stevenson, and M. J. Glennie. "Trispecific F (ab') 3 derivatives that use cooperative signaling via the TCR/CD3 complex and CD2 to activate and redirect resting cytotoxic T cells." The Journal of Immunology 147.1 (1991): 60-69.), and by controlled Fab arm exchange (cFAE) according to Labrijn, Aran F., et al. "Efficient generation of stable bispecific IgG1 by controlled Fab-arm exchange." Proceedings of the National Academy of Sciences 110.13 (2013): 5145-5150.

Conjugates for Diagnosis and Research Applications

According to some fifth embodiments of the 19th aspect, the conjugate comprises a detectable moiety. Examples of detectable moieties include various enzymes, prosthetic groups, fluorescent materials, luminescent materials, bioluminescent materials, radioactive materials, positron emitting metals, nonradioactive paramagnetic metal ions and reactive moieties. The detectable substance can be coupled or conjugated either directly to the antibody or fragment thereof or indirectly, e.g. through a linker known in the art or another moiety, using techniques known in the art. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRPO), alkaline phosphatase, β-galactosidase, acetylcholinesterase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like.

Examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include 125I, 131I, 111In or 99mTc.

Detection of expression of a chemokine receptor or CCR8 generally involves contacting a biological sample (tumor, cells, tissue, or body fluid of an individual) with one or more antibodies or fragments according to the current invention (optionally conjugated to a detectable moiety), and detecting whether or not the sample is positive for the chemokine receptor or CCR8, or whether the sample has altered (e.g., reduced or increased) expression as compared to a control sample.

Aspect 20—Pharmaceutical Composition

According to a 20$^{th}$ aspect, there is provided a pharmaceutical composition comprising an antibody or antigen-binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect. Preferably, the pharmaceutical composition comprises an antibody or fragment thereof or a conjugate according to any one of the embodiments described herein, or a combination thereof, in a therapeutically effective amount together with a pharmaceutically acceptable carrier, excipient, or stabilizer.

Pharmaceutical compositions can be prepared by mixing the antibody, fragment, or conjugate having the desired degree of purity with optional physiologically acceptable carriers, excipients or stabilizers (Remington, Joseph Price. Remington: The science and practice of pharmacy. Vol. 1. Lippincott Williams & Wilkins, 2006.). Pharmaceutical compositions may be for example in the form of lyophilized formulations or aqueous solutions.

Carriers, Excipients, Stabilizers

Acceptable carriers, excipients, or stabilizers are nontoxic to recipients at the dosages and concentrations employed, and include buffers such as phosphate buffer (e.g. PBS), citrate buffer, and other organic acid buffer; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (e.g. less than about 10 residues) polypeptide; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as Tween®, Pluronic® or polyethylene glycol (PEG).

Multiple therapeutically active compounds According to the current invention a pharmaceutical composition may contain more than one active compound, e.g. as necessary or beneficial for the particular indication being treated.

According to some first embodiments of the 20$^{th}$ aspect, the pharmaceutical composition comprises one or more further therapeutically active compounds.

In some preferred of the first embodiments of the 20th aspect, the pharmaceutical composition comprises an antibody or antigen-binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect and a) an antibody or a small molecule targeting a checkpoint protein, such as PD1, PD-L1 or CTLA-4, and/or b) an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1, and/or c) an antibody targeting a protein which is specifically expressed by tumor cells and/or d) an antibody or a small molecule targeting HER2 and/or EGFR, and/or e) the standard of care for any of head and neck cancer, breast cancer, gastric cancer, lung cancer, squamous cell carcinoma, esophageal tumor, melanoma, bladder cancer, liver cancer, and/or prostate cancer, and/or f) a chemotherapeutic agent, preferably a taxane, paclitaxel, doxorubicin, cis-platin, carboplatin, oxaliplatin, paclitaxel or gemcitabine, and/or g) a targeted kinase inhibitor, such as Sorafinib, Regorafenib, or MEKi-1.

Combination with Checkpoint Inhibitors

According to some preferred embodiments A of the first embodiments of the 20$^{th}$ aspect, the pharmaceutical composition furthermore comprises an antibody or a small molecule targeting a checkpoint protein, such as PD1, PD-L1 or CTLA-4. Suitable checkpoint targeting antibodies include Nivolumab (PD1; Human IgG4), Pembrolizumab (PD1; Humanized IgG4), Atezolizumab (PD-L1; Humanized IgG1), Avelumab (PD-L1; Human IgG1), Durvalumab (PD-L1; Human IgG1), Cemiplimab, cemiplimab-rwlc (PD-1; Human mAb), Dostarlimab (TSR-042) (PD-1; Humanized IgG4), or Ipilimumab (CTLA-4; Human IgG1).

In some embodiments, the antibody or a small molecule targeting a checkpoint protein targets CTLA-4, PDL1, PDL2, PD1, B7-H3, B7-H4, BTLA, HVEM, TIM3, GALS, LAG3, VISTA, KIR, 2B4, CD160, CGEN-15049, CHK 1, CHK2, A2aR, B-7 family ligands or a combination thereof.

Combination with Chemokine Receptor Antibodies

According to some preferred embodiments B of the first embodiments of the 20$^{th}$ aspect, the pharmaceutical composition furthermore comprises an antibody or a small molecule targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1. Suitable antibodies targeting a further chemokine receptor include the antibodies provided according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or Mogamulizumab.

Combination with HER2 or EGFR Targeting Antibodies or Molecules

According to some preferred embodiments C of the first embodiments of the 20$^{th}$ aspect, the pharmaceutical composition furthermore comprises an antibody or a small molecule targeting HER2 and/or EGFR. Suitable antibodies targeting HER2 are Trastuzumab (HER2; Humanized IgG1), Pertuzumab (HER2; humanized IgG1), Ado-trastuzumab emtansine (HER2; humanized IgG1; ADC), [fam-] trastuzumab deruxtecan, fam-trastuzumab deruxtecan-nxki (HER2; Humanized IgG1 ADC), Sacituzumab govitecan; sacituzumab govitecan-hziy (TROP-2; Humanized IgG1 ADC) and/or Margetuximab (HER2; Chimeric IgG1). Suitable antibodies targeting EGFR are Cetuximab (EGFR; Chimeric IgG1), Panitumumab (EGFR; Human IgG2), and Necitumumab (EGFR; Human IgG1).

Combination with Therapeutic Antibodies

According to some embodiments D of the first embodiments of the 20$^{th}$ aspect, the pharmaceutical composition comprises a further therapeutic antibody selected from Muromonab-CD3 (CD3; Murine IgG2a), Efalizumab (CD11a; Humanized IgG1), Tositumomab-I131 (CD20; Murine IgG2a), Nebacumab (Endotoxin; Human IgM), Edrecolomab (EpCAM; Murine IgG2a), Catumaxomab (EPCAM/CD3; Rat/mouse bispecific mAb), Daclizumab (IL-2R; Humanized IgG1), Abciximab (GPIIb/IIIa; Chimeric IgG1 Fab), Rituximab (CD20; Chimeric IgG1), Basiliximab (IL-2R; Chimeric IgG1), Palivizumab (RSV; Humanized IgG1), Infliximab (TNF; Chimeric IgG1), Trastuzumab (HER2; Humanized IgG1), Adalimumab (TNF; Human IgG1), Ibritumomab tiuxetan (CD20; Murine IgG1), Omalizumab (IgE; Humanized IgG1), Cetuximab (EGFR; Chimeric IgG1), Bevacizumab (VEGF; Humanized IgG1), Natalizumab (a4 integrin; Humanized IgG4), Panitumumab (EGFR; Human IgG2), Ranibizumab (VEGF; Humanized IgG1 Fab), Eculizumab (C5; Humanized IgG2/4), Certolizumab pegol (TNF; Humanized Fab, pegylated), Ustekinumab (IL-12/23; Human IgG1), Canakinumab (IL-1β; Human IgG1), Golimumab (TNF; Human IgG1), Ofatumumab (CD20; Human IgG1), Tocilizumab (IL-6R; Humanized IgG1), Denosumab (RANK-L; Human IgG2), Belimumab (BLyS; Human IgG1), Ipilimumab (CTLA-4; Human IgG1), Brentuximab vedotin (CD30; Chimeric IgG1; ADC), Pertuzumab (HER2; humanized IgG1), Ado-trastuzumab emtansine (HER2; humanized IgG1; ADC), Raxibacumab (B. anthrasis PA; Human IgG1), Obinutuzumab (CD20; Humanized IgG1 Glycoengineered), Siltuximab (IL-6; Chimeric IgG1), Ramucirumab (VEGFR2; Human IgG1), Vedolizumab (a4137 integrin; humanized IgG1), Nivolumab (PD1; Human IgG4), Pembrolizumab (PD1; Humanized IgG4), Blinatumomab (CD19, CD3; Murine bispecific tandem scFv), Alemtuzumab (CD52; Humanized IgG1), Evolocumab (PCSK9; Human IgG2), Idarucizumab (Dabigatran; Humanized Fab), Necitumumab (EGFR; Human IgG1), Dinutuximab (GD2; Chimeric IgG1), Secukinumab (IL-17a; Human IgG1), Mepolizumab (IL-5; Humanized IgG1), Alirocumab (PCSK9; Human IgG1), Daratumumab (CD38; Human IgG1), Elotuzumab (SLAMF7; Humanized IgG1), Ixekizumab (IL-17a; Humanized IgG4), Reslizumab (IL-5; Humanized IgG4), Olaratumab (PDGFRα; Human IgG1), Bezlotoxumab (*Clostridium difficile* enterotoxin B; Human IgG1), Atezolizumab (PD-L1; Humanized IgG1), Obiltoxaximab (B. anthrasis PA; Chimeric IgG1), Brodalumab (IL-17R; Human IgG2), Dupilumab (IL-4R α; Human IgG4), Inotuzumab ozogamicin (CD22; Humanized IgG4; ADC), Guselkumab (IL-23 p19; Human IgG1), Sarilumab (IL-6R; Human IgG1), Avelumab (PD-L1; Human IgG1), Emicizumab (Factor Ixa, X; Humanized IgG4, bispecific), Ocrelizumab (CD20; Humanized IgG1), Benralizumab (IL-5R α; Humanized IgG1), Durvalumab (PD-L1; Human IgG1), Gemtuzumab ozogamicin (CD33; Humanized IgG4; ADC), Erenumab, erenumab-aooe (CGRP receptor; Human IgG2), Galcanezumab, galcanezumab-gnlm (CGRP; Humanized IgG4), Burosumab, burosumab-twza (FGF23; Human IgG1), Lanadelumab, lanadelumab-flyo (Plasma kallikrelin; Human IgG1), Mogamulizumab, mogamulizumab-kpkc (CCR4; Humanized IgG1), Tildrakizumab; tildrakizumab-asmn (IL-23 p19; Humanized IgG1), Fremanezumab, fremanezumab-vfrm (CGRP; Humanized IgG2), Ravulizumab, ravulizumab-cwvz (C5; Humanized IgG2/4), Cemiplimab, cemiplimab-rwlc (PD-1; Human mAb), Ibalizumab, ibalizumab-uiyk (CD4; Humanized IgG4), Emapalumab, emapalumab-lzsg (IFNg; Human IgG1), Moxetumomab pasudotox, moxetumomab pasudotox-tdfk (CD22; Murine IgG1 dsFv immunotoxin), Caplacizumab, caplacizumab-yhdp (von Willebrand factor; Humanized Nanobody), Risankizumab, risankizumab-rzaa (IL-23 p 19; Humanized IgG1), Polatuzumab vedotin, polatuzumab vedotin-piiq (CD79b; Humanized IgG1 ADC), Romosozumab, romosozumab-aqqg (Sclerostin; Humanized IgG2), Brolucizumab, brolucizumab-dbll (VEGF-A; Humanized scFv), Crizanlizumab; crizanlizumab-tmca (CD62 (aka P-selectin); Humanized IgG2), Enfortumab vedotin, enfortumab vedotin-ejfv (Nectin-4; Human IgG1 ADC), [fam-]trastuzumab deruxtecan, fam-trastuzumab deruxtecan-nxki (HER2; Humanized IgG1 ADC), Teprotumumab, teprotumumab-trbw (IGF-1R; Human IgG1), Eptinezumab, eptinezumab-jjmr (CGRP; Humanized IgG1), Isatuximab, isatuximab-irfc (CD38; Chimeric IgG1), Sacituzumab govitecan; sacituzumab govitecan-hziy (TROP-2; Humanized IgG1 ADC), Inebilizumab (CD19; Humanized IgG1), Leronlimab (CCR5; Humanized IgG4), Satralizumab (IL-6R; Humanized IgG2), Narsoplimab (MASP-2, Human IgG4), Tafasitamab (CD19; Humanized IgG1), REGNEB3 (Ebola virus; mixture of 3 human IgG1), Naxitamab (GD2; Humanized IgG1), Oportuzumab monatox (EpCAM; Humanized scFv immunotoxin), Belantamab mafodotin (B-cell maturation antigen; Humanized IgG1 ADC), Margetuximab (HER2; Chimeric IgG1), Tanezumab (Nerve growth factor; Humanized IgG2), Dostarlimab (TSR-042) (PD-1; Humanized IgG4), Teplizumab (CD3; Humanized IgG1), Aducanumab (Amyloid beta; Human IgG1), Sutimlimab (BIVV009) (C1s; Humanized IgG4), Evinacumab (Angiopoietin-like 3; Human IgG4).

Combination with Cytotoxic or Cytostatic Agents

According to some embodiments E of the first embodiments of the 20$^{th}$ aspect, the pharmaceutical composition furthermore comprises a cytostatic and/or cytotoxic agent selected from radionuclides, alkylating agents, DNA cross-linking agents, DNA intercalating agents (e.g., groove binding agents such as minor groove binders), cell cycle modulators, apoptosis regulators, kinase inhibitors, protein synthesis inhibitors, mitochondria inhibitors, nuclear export inhibitors, topoisomerase I inhibitors, topoisomerase II inhibitors, RNA/DNA antimetabolites and antimitotic agents, as described according to the second embodiments of the 19th aspect.

In some preferred embodiments, the cytotoxic agent is an auristatin, a maytansinoid, a kinesin-spindle protein (KSP) inhibitor, a nicotinamide phosphoribosyltransferase (NAMPT) inhibitor or a pyrrolobenzodiazepine derivative.

Aspect 21—MED Use/Methods of Treatment

According to a 21$^{st}$ aspect, there is provided the antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect for use as a medicament. Also, there is provided the use of the antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect for the manufacture of a medicament, e.g. for the treatment of a tumor or a disease involving cells expressing a chemokine receptor and in particular CCR8.

Furthermore, there is provided a method of treating a disease, the method comprising administering an effective dose of the antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect to a patient in need thereof.

For therapeutic applications, the antibody or antigen binding fragment or the conjugate or the pharmaceutical composition according to the invention, can be administered to a patient or subject, e.g. to a human or non-human subject, in a pharmaceutically acceptable dosage form. For example, administration may occur intravenously as a bolus or by continuous infusion over a period of time, by intramuscular, intraperitoneal, intra-cerebrospinal, subcutaneous, intra-articular, intrasynovial, intrathecal, oral, topical, or inhalation routes. The antibodies, fragments, conjugates and pharmaceutical compositions according to the current invention are particularly suitable to be administered by intra-tumoral, peri-tumoral, intra-lesional, or peri-lesional routes, to exert local as well as systemic therapeutic effects.

Possible administration routes include parenteral (e.g., intramuscular, intravenous, intra-arterial, intraperitoneal, or subcutaneous), intrapulmonary and intranasal. In addition, the antibodies, fragments, conjugates and pharmaceutical compositions might be administered by pulse infusion, with, e.g., declining doses of the antibody, fragment or conjugate. Preferably, the dosing is given by injections, most preferably intravenous or subcutaneous injections, depending in part on whether the administration is brief or chronic. The amount to be administered may depend on a variety of factors such as the clinical symptoms, weight of the patient or subject, and whether other drugs are administered. The skilled artisan will recognize that the route of administration will vary depending on the disorder or condition to be treated.

Dosing frequency of the antibody may range from once every 3-6 months to weekly, biweekly (BIW) or daily dosing. Similarly, dose levels range from a low mg fixed dose (daily, weekly, biweekly, or monthly, depending on antibody) up to approximately 1 g doses. Dosing frequency depends on a variety of factors including the concentration and turnover rate of the target, biodistribution of the target, half-life of the antibodies, fragments or conjugates and potential pharmacodynamic effects that may enhance the biological effects of the antibodies, fragments, conjugates and pharmaceutical compositions beyond its presence in pharmacologically relevant levels.

In some embodiments, the anti-CCR8 antibody is administered with a dose of 1 mg/kg e.g. daily, weekly, q2w, q3w or q4w. In some embodiments, the anti-CCR8 antibody is administered with a dose of 1 to 30 mg/kg, preferably 5 to 10 mg/kg, e.g. daily, weekly, q2w, q3w or q4w. In some embodiments, the anti-CCR8 antibody is administered with a dose of 4 to 8 mg/kg, preferably 5 to 6 mg/kg, e.g. daily, weekly, q2w, q3w or q4w.

For the prevention or treatment of disease, the appropriate dosage of antibody will depend on the type of disease to be treated, the severity and course of the disease, whether the antibody is administered for preventive or therapeutic purposes, previous therapy, the subject's clinical history and response to the antibody variant, and the discretion of the attending physician or health veterinary professional. The antibody is suitably administered to the subject at one time or over a series of treatments.

As shown in example 12.4.2 it was surprisingly observed that even a single dose might be sufficient to establish a substantial treatment response. According to the current invention, there is therefore provided an anti-CCR8 antibody inducing ADCC and/or ADCP for use in the treatment of a tumor, wherein only a single dose of the anti-CCR8 antibody is administered to a subject, such that no further dose of the same or a different anti-CCR8 antibody is administered to the subject. Such a method is not only logistically superior and particularly convenient for patients but also avoids issues with patient compliance. When administered intravenously, the pharmaceutical composition comprising the antibodies, fragments or conjugates can be administered by infusion over a period of about 0.5 to about 5 hours. In some embodiments, infusion may occur over a period of about 0.5 to about 2.5 hours, over a period of about 0.5 to about 2.0 hours, over a period of about 0.5 to about 1.5 hours, or over a period of about 1.5 hours, depending upon the antibodies, fragments, conjugates and pharmaceutical compositions being administered and the amount of antibody, fragment or conjugate being administered.

Aspect 22—Second MED Use/Methods of Treatment

Treatment with an anti-CCR8 antibody according to the current invention showed remarkable efficacies in various syngeneic tumor models. In some cases, administration of an effective dose of the antibody or antigen-binding fragment to a group of diseased subjects leads to
a. a complete response in at least 15%, 20% or 25% of the subjects, and/or to
b. an overall response rate in at least 40%, 50%, 60% or 70% of the subjects.

According to a 22$^{nd}$ aspect, there is provided the antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect for use in the treatment of a tumor or a disease characterized by chemokine receptor positive cells, preferably CCR8 positive cells, such as CCR8 positive regulatory T cells. The treatment may occur as discussed for aspect 21.

Preferably, there is provided the antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect for use in the treatment of a tumor or a disease characterized by the involvement of cells expressing the targeted seven transmembrane receptor or chemokine receptor.

Multiple modes of action can be envisioned for the antibodies, antigen-binding fragments or conjugates according to the current invention. One mode of action is the conjugation of an inventive anti-chemokine receptor antibody to a drug in the form of an antibody drug conjugate (ADC). Another mode of action is the ability of an antibody targeting a chemokine receptor to induce ADCC. A third mode of action resides in the ability of the antibody targeting chemokine receptor to induce ADCP.

The specific CCR8 antibodies or antigen binding fragments in particular according to the 8$^{th}$, 11$^{th}$, 12$^{th}$, 13$^{th}$ and 14$^{th}$ aspect, are particularly suited for an ADCC/ADCP based approach, e.g. because they are characterized by a particularly low internalization or are non-internalizing antibodies, thereby residing on the surface of the CCR8 expressing target cells and causing their efficient killing, as demonstrated for activated human Tregs in vitro (examples 10.3.3 ff, examples 10.3.4 ff) or in vivo (examples 12 ff). Regulatory T cells (Tregs) promote tumor growth by suppressing the function of effector T cells, including tumor responsive T cells in the tumor microenvironment. In fact, Tregs are one of the key resistance mechanisms hampering the efficacy of immune checkpoint inhibitors (ICIs) in many indications.

CCR8 is a surface receptor of the GPCR family of chemokine receptors, which is predominantly expressed on activated immune suppressive Tregs frequently found in tumors. Unlike other approaches directed against these suppressive T cells, targeting CCR8 offers the opportunity to deplete intra-tumoral Tregs without impacting resting Tregs or other immune cells systemically. Thus, targeting CCR8 may be superior in terms of both efficacy and safety. This mode of action can thus be used in tumors with intra-tumoral Tregs but can also be used in other diseases characterized by an aberrant presence of activated, i.e. CCR8 expressing Tregs.

Specific Indications

In principle, the antibodies, fragments, conjugates and pharmaceutical compositions can be used in the treatment of any cancer involving CCR8 expressing cells. For example, the cancer may comprise tumor cells expressing CCR8, such as B cell lymphoma and T cell lymphoma. In the alternative, the cancer may comprise intra-tumoral Tregs expressing CCR8. As shown in example 11, CCR8 is upregulated in several tumor indications, such as T-cell acute lymphoblastic leukemia, breast cancer, triple-negative breast cancer, triple positive breast cancer, non-small cell lung cancer (NSCLC), small cell lung cancer (SCLC), testicular cancer, gastric cancer, head and neck squamous cell carcinoma, thymoma, esophageal adenocarcinoma, colorectal cancer, pancreatic adenocarcinoma, ovarian cancer or cervical cancer, acute myeloid leukemia, kidney cancer, bladder cancer, skin cancer, melanoma, thyroid cancer, mesothelioma, sarcoma and prostate cancer. According to some preferred embodiments, the use as a medicament is the use in the treatment of head and neck cancer, breast cancer, gastric cancer, lung cancer, squamous cell carcinoma, esophageal tumor, melanoma, bladder cancer, liver cancer, and/or prostate cancer.

According to some first embodiments according to the $22^{nd}$ aspect the tumor is selected from Adrenal cancer (e.g. Adrenocortical carcinoma or Pheochromocytoma), Bladder cancer (e.g. Transitional cell carcinoma, Transitional cell carcinoma-Papillary), Brain cancer (e.g. Glioma-Astrocytoma, Glioma-Astrocytoma-Glioblastoma, Glioma-Oligoastrocytoma, Glioma-Oligodendroglioma), Breast cancer (e.g. ADC, ADC-Ductal, ADC-Ductal-TNBC, ADC-Ductal-TPBC, ADC-Lobular), Colorectal cancer (e.g. ADC), Esophageal cancer (e.g. ADC), Esophageal cancer (e.g. SCC), Gastric cancer (e.g. ADC, ADC-Diffuse, ADC-Intestinal, ADC-Intestinal-Tubular), Head and Neck cancer (e.g. Laryngeal cancer-SCC, SCC, Oral cancer-SCC), Kidney cancer (e.g. ccRCC, Chromophobe, Papillary, Papillary-Type I, Papillary-Type II), Liver cancer (e.g. HCC), Lung cancer (e.g. NSCLC-ADC, NSCLC-ADC-Mixed, NSCLC-SCC, SCLC), Mesothelioma (e.g. Epithelioid), Ovarian cancer (e.g. ADC-Cystadenocarcinoma-Papillary serous), Pancreatic cancer (e.g. ADC-Ductal), Prostate cancer (e.g. ADC-Acinar type), Sarcoma (e.g. Leiomyosarcoma, Liposarcoma-Dedifferentiated, Malignant fibrous histiocytoma), Skin cancer (e.g. Melanoma), Testicular cancer (e.g. Germ cell tumor-Seminoma), Thymoma, Thyroid cancer (e.g. Follicular carcinoma, Papillary carcinoma-Classical variant), or Uterine cancer (e.g. Cervical-SCC, Cervical-SCC-Keratinizing, Cervical-SCC-Non-keratinizing, Endometrial-ADC-Endometrioid, Endometrial-ADC-Papillary serous, Endometrial-Carcinosarcoma-Malignant mixed mullerian tumor), B cell lymphoma and T cell lymphoma (cf. Table 11.1.2).

According to some second embodiments according to the $22^{nd}$ aspect the tumor is selected from T-cell acute lymphoblastic leukemia, breast cancer, triple-negative breast cancer, triple positive breast cancer, non-small cell lung cancer (NSCLC), small cell lung cancer (SCLC), testicular cancer, gastric cancer, head and neck squamous cell carcinoma, thymoma, esophageal adenocarcinoma, colorectal cancer, pancreatic adenocarcinoma, ovarian cancer or cervical cancer, acute myeloid leukemia, kidney cancer, bladder cancer, skin cancer, skin cancer, melanoma, thyroid cancer, mesothelioma, sarcoma and prostate cancer or any other cancer involving chemokine receptor or CCR8 expressing cells. Preferably the tumor is selected from head and neck cancer, breast cancer, gastric cancer, lung cancer, squamous cell carcinoma, esophageal tumor, melanoma, bladder cancer, liver cancer, and/or prostate cancer.

Combination Treatment

According to some third embodiments according to the $22^{nd}$ aspect, which may be and are suggested to be combined with the embodiments of the first and/or second embodiments according to the $22^{nd}$ aspect, the use is a use in simultaneous, separate, or sequential combination with one or more further therapeutically active compounds. Examples for combination treatments are provided in examples 12.6, 12.6.1, 12.6.2, 12.6.3, 12.6.4, 12.6.5, 12.6.6, 12.6.7, 12.6.8 and 12.6.9, demonstrating the broad applicability of the anti-CCR8 antibodies according to the current invention and anti-CCR8 antibodies in general in combination treatment.

Anti-chemokine receptor antibodies, e.g. CCR8 antibodies, or ADCs, may be used adjunctive to, or with, other agents or treatments having anti-cancer properties. When used adjunctively, the antibodies, fragments or conjugates and other agent(s) may be formulated together in a single, combination pharmaceutical composition or formulation, as described for the $20^{th}$ aspect, or may be preferably formulated and administered separately, either on a single coordinated dosing regimen or on different dosing regimens.

Sequential Administration: Combination Partner after Anti-CCR8 Antibody Treatment It was found according to the current invention, that administration of the anti-CCR8 antibody as a first agent and administration of the one or more further therapeutically active compounds thereafter increased the efficacy in an unforeseen way.

According to a preferred treatment scheme, treatment starts with administration of the anti-CCR8 antibody (e.g. daily, weekly, q2w, q3w or q4w as described above), optionally followed by administration of the one or more further therapeutically active compounds. As described in examples 12.6 ff., starting the administration of the second therapeutic agent or therapy after the initial dose of anti-CCR8 antibody was associated with further improved efficacy. Without being bound by theory, the time between the initial doses should be chosen to allow for an intra-tumoral Treg depletion of at least 30% 40%, 50%, or 60%. The one or more further therapeutically active compounds or combination partner is suggested to be any of those described herein for this purpose. For example, the one or more further therapeutically active compounds may comprise a checkpoint inhibitor (e.g. anti-PD1/anti-PD-L1/anti-CTLA4 antibody), an antibody targeting a protein which is specifically expressed by the tumor cells, or a chemotherapeutic agent described herein.

In a different embodiment, treatment starts with the administration of a chemotherapeutic agent and is followed by administration of the anti-CCR8 antibody (e.g. weekly or biweekly schedule).

Further Therapeutically Active Compounds for Combination Treatment

Agents administered adjunctively with an anti-chemokine receptor antibody or ADC, e.g. with an anti-CCR8 antibody or ADC, may have complementary activities to the anti-chemokine receptor antibody or ADC, such that the antibodies/ADCs and other agents do not adversely affect each other. Agents that may be used adjunctively with the anti-chemokine receptor or anti-CCR8 antibodies or ADCs according to the current invention can be alkylating agents, angiogenesis inhibitors, antibodies, antimetabolites, antimitotics, antiproliferatives, antivirals, aurora kinase inhibitors, apoptosis promoters (for example, Bcl-2 family inhibitors), activators of death receptor pathway, Bcr-Abl kinase inhibitors, BiTE (Bi-Specific T cell Engager) antibodies, antibody drug conjugates, biologic response modifiers, cyclin-dependent kinase inhibitors, cell cycle inhibitors, cyclooxygenase-2 inhibitors, DVDs, leukemia viral oncogene homolog (ErbB2) receptor inhibitors, growth factor inhibitors, heat shock protein (HSP)-90 inhibitors, histone deacetylase (HDAC) inhibitors, hormonal therapies, immunologicals, inhibitors of inhibitors of apoptosis proteins (IAPs), intercalating antibiotics, kinase inhibitors, kinesin inhibitors, Jak2 inhibitors, mammalian target of rapamycin inhibitors, microRNAs, mitogen-activated extracellular signal-regulated kinase inhibitors, multivalent binding proteins, non-steroidal anti-inflammatory drugs (NSAIDs), poly ADP (adenosine diphosphate)-ribose polymerase (PARP) inhibitors, platinum chemotherapeutics, polo-like kinase (Plk) inhibitors, phosphoinositide-3 kinase (PI3K) inhibitors, proteasome inhibitors, purine analogs, pyrimidine analogs, receptor tyrosine kinase inhibitors, retinoids/deltoids plant alkaloids, small inhibitory ribonucleic acids (siRNAs), topoisomerase inhibitors, ubiquitin ligase inhibitors, and the like, as well as combinations of one or more of these agents.

According to some highly preferred embodiments of the third embodiments of the $22^{nd}$ aspect, there is provided the antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect, or a conjugate according to the $19^{th}$ aspect or the pharmaceutical composition according to the $20^{th}$ aspect for use in simultaneous, separate, or sequential combination
(i) with one or more further therapeutically active compounds, preferably selected from
  a) an antibody or a small molecule targeting a checkpoint protein, such as PD1, PD-L1 or CTLA-4,
  b) an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
  c) an antibody targeting a protein which is specifically expressed by the tumor cells,
  d) an antibody or a small molecule targeting HER2 and/or EGFR,
  e) the standard of care for any of head and neck cancer, breast cancer, gastric cancer, lung cancer, squamous cell carcinoma, esophageal tumor, melanoma, bladder cancer, liver cancer, and/or prostate cancer, and/or
  f) a chemotherapeutic agent, preferably a taxane, paclitaxel, doxorubicin, cis-platin, carboplatin, oxaliplatin or gemcitabine,
  g) a targeted kinase inhibitor, such as Sorafinib, Regorafenib, or MEKi-1, and/or
(ii) with radiation therapy, and or
(iii) with depletion of intra-tumoral B cells,
e.g. in the treatment of a tumor or a disease, preferably characterized by chemokine receptor positive cells, such as CCR8 positive cells, such as CCR8 positive regulatory T cells.

Suitable taxanes may be selected e.g. from paclitaxel, abraxane, cabazitaxel, or docetaxel, or derivatives thereof.

Embodiments wherein the anti-CCR8 antibody is combined with doxorubicin, taxanes, cis-platin or carboplatin, embodiments wherein the anti-CCR8 antibody is combined with trastuzumab or pertuzumab and embodiments wherein the anti-CCR8 antibody is combined with a PD-L1 antibody such as atezolizumab are particularly suitable for the treatment of breast cancer, such as stage IV breast cancer. Embodiments wherein the anti-CCR8 antibody is combined with cis-/carboplatin, paclitaxel, docetaxel or gemcitabine, embodiments wherein the anti-CCR8 antibody is combined with avastin, EGFR inhibitor (such as Tarceva or Iressa), ALK inhibitor, ROS inhibitor, BRAF inhibitor or NTRK inhibitor, and embodiments wherein the anti-CCR8 antibody is combined with nivolumab, pembrolizumab or atezolizumab, or a derivative of any of these, are particularly suitable for the treatment of NSCLC. Embodiments wherein the anti-CCR8 antibody is combined with nivolumab, pembrolizumab or ipilimumab (CTLA4), anti IL2 antibody or a derivative of any of these, embodiments wherein the anti-CCR8 antibody is combined with BRAF inhibitor or MEK inhibitor and embodiments wherein the anti-CCR8 antibody is combined with darcabazine, paclitaxel, carboplatin, or cis-platin are particularly suitable for the treatment of melanoma.

Combination with Checkpoint Inhibitors

Tumors were found to be particularly responsive to anti-CCR8 antibody therapy, if the tumor was responsive to immune checkpoint inhibition, or if the tumor showed high or medium immune infiltration and if substantial numbers of CD8+ T cells and/or NK cells were present or could be induced, e.g. in addition to high CCR8/FoxP3 ratios (cf. example 12.6 ff, cf. responsive syngeneic models).

According to some particularly preferred embodiments A of the third embodiments according to the $22^{nd}$ aspect, the one or more further therapeutically active compounds comprise(s) an antibody or a small molecule targeting a checkpoint protein, such as PD1, PD-L1 or CTLA-4. Suitable checkpoint targeting antibodies include Nivolumab (PD1; Human IgG4), Pembrolizumab (PD1; Humanized IgG4), Atezolizumab (PD-L1; Humanized IgG1), Avelumab (PD-L1; Human IgG1), Durvalumab (PD-L1; Human IgG1), Cemiplimab, cemiplimab-rwlc (PD-1; Human mAb), Dostarlimab (TSR-042) (PD-1; Humanized IgG4), or Ipilimumab (CTLA-4; Human IgG1). In some embodiments, the antibody or small molecule targeting a checkpoint protein targets and/or inhibits a checkpoint protein which may be CTLA-4, PDL1, PDL2, PD1, B7-H3, B7-H4, BTLA, HVEM, TIM3, GALS, LAG3, VISTA, KIR, 2B4, CD160, CGEN-15049, CHK 1, CHK2, A2aR, B-7 family ligands or a combination thereof. Examples 12.6 ff. show a superior therapeutic effect obtained by combination of an antibody targeting checkpoint protein PD-L1 and an inventive antibody according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect. Examples 12.6 ff. demonstrate that combination of an inventive antibody according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect and an antibody targeting checkpoint protein CTLA4 showed likewise excellent efficacy in a tumor model.

Combination with Chemokine Receptor Antibodies

According to some preferred embodiments B of the third embodiments according to the $22^{nd}$ aspect, the one or more further therapeutically active compounds comprise(s) an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1. Suitable antibodies targeting a further chemokine receptor include the antibodies provided according to the $6^{th}$ aspect, e.g. a CCR5 antibody, CXCR5 antibody, CCR4 antibody, or Mogamulizumab.

Combination with HER2 or EGFR Targeting Antibodies or Molecules

According to some preferred embodiments C of the third embodiments according to the $22^{nd}$ aspect, the one or more further therapeutically active compounds comprise(s) a small molecule or an antibody targeting HER2 and/or EGFR. Suitable antibodies targeting HER2 are Trastuzumab (HER2; Humanized IgG1), Pertuzumab (HER2; humanized IgG1), Ado-trastuzumab emtansine (HER2; humanized IgG1; ADC), [fam-]trastuzumab deruxtecan, fam-trastuzumab deruxtecan-nxki (HER2; Humanized IgG1 ADC), Sacituzumab govitecan; sacituzumab govitecan-hziy (TROP-2; Humanized IgG1 ADC) and/or Margetuximab (HER2; Chimeric IgG1). Suitable antibodies targeting EGFR are Cetuximab (EGFR; Chimeric IgG1), Panitumumab (EGFR; Human IgG2), and Necitumumab (EGFR; Human IgG1).

Combination with Therapeutic Antibodies

According to some embodiments D of the third embodiments according to the $22^{nd}$ aspect, the one or more further therapeutically active compounds comprise(s) a further therapeutic antibody selected from Muromonab-CD3 (CD3; Murine IgG2a), Efalizumab (CD11a; Humanized IgG1), Tositumomab-I131 (CD20; Murine IgG2a), Nebacumab (Endotoxin; Human IgM), Edrecolomab (EpCAM; Murine IgG2a), Catumaxomab (EPCAM/CD3; Rat/mouse bispecific mAb), Daclizumab (IL-2R; Humanized IgG1), Abciximab (GPIIb/IIIa; Chimeric IgG1 Fab), Rituximab (CD20; Chimeric IgG1), Basiliximab (IL-2R; Chimeric IgG1), Palivizumab (RSV; Humanized IgG1), Infliximab (TNF; Chimeric IgG1), Trastuzumab (HER2; Humanized IgG1), Adalimumab (TNF; Human IgG1), Ibritumomab tiuxetan (CD20; Murine IgG1), Omalizumab (IgE; Humanized IgG1), Cetuximab (EGFR; Chimeric IgG1), Bevacizumab (VEGF; Humanized IgG1), Natalizumab (a4 integrin; Humanized IgG4), Panitumumab (EGFR; Human IgG2), Ranibizumab (VEGF; Humanized IgG1 Fab), Eculizumab (C5; Humanized IgG2/4), Certolizumab pegol (TNF; Humanized Fab, pegylated), Ustekinumab (IL-12/23; Human IgG1), Canakinumab (IL-113; Human IgG1), Golimumab (TNF; Human IgG1), Ofatumumab (CD20; Human IgG1), Tocilizumab (IL-6R; Humanized IgG1), Denosumab (RANK-L; Human IgG2), Belimumab (BLyS; Human IgG1), Ipilimumab (CTLA-4; Human IgG1), Brentuximab vedotin (CD30; Chimeric IgG1; ADC), Pertuzumab (HER2; humanized IgG1), Ado-trastuzumab emtansine (HER2; humanized IgG1; ADC), Raxibacumab (B. anthrasis PA; Human IgG1), Obinutuzumab (CD20; Humanized IgG1 Glycoengineered), Siltuximab (IL-6; Chimeric IgG1), Ramucirumab (VEGFR2; Human IgG1), Vedolizumab (a4137 integrin; humanized IgG1), Nivolumab (PD1; Human IgG4), Pembrolizumab (PD1; Humanized IgG4), Blinatumomab (CD19, CD3; Murine bispecific tandem scFv), Alemtuzumab (CD52; Humanized IgG1), Evolocumab (PCSK9; Human IgG2), Idarucizumab (Dabigatran; Humanized Fab), Necitumumab (EGFR; Human IgG1), Dinutuximab (GD2; Chimeric IgG1), Secukinumab (IL-17a; Human IgG1), Mepolizumab (IL-5; Humanized IgG1), Alirocumab (PCSK9; Human IgG1), Daratumumab (CD38; Human IgG1), Elotuzumab (SLAMF7; Humanized IgG1), Ixekizumab (IL-17a; Humanized IgG4), Reslizumab (IL-5; Humanized IgG4), Olaratumab (PDGFRα; Human IgG1), Bezlotoxumab (Clostridium difficile enterotoxin B; Human IgG1), Atezolizumab (PD-L1; Humanized IgG1), Obiltoxaximab (B. anthrasis PA; Chimeric IgG1), Brodalumab (IL-17R; Human IgG2), Dupilumab (IL-4R α; Human IgG4), Inotuzumab ozogamicin (CD22; Humanized IgG4; ADC), Guselkumab (IL-23 p19; Human IgG1), Sarilumab (IL-6R; Human IgG1), Avelumab (PD-L1; Human IgG1), Emicizumab (Factor Ixa, X; Humanized IgG4, bispecific), Ocrelizumab (CD20; Humanized IgG1), Benralizumab (IL-5R α; Humanized IgG1), Durvalumab (PD-L1; Human IgG1), Gemtuzumab ozogamicin (CD33; Humanized IgG4; ADC), Erenumab, erenumab-aooe (CGRP receptor; Human IgG2), Galcanezumab, galcanezumab-gnlm (CGRP; Humanized IgG4), Burosumab, burosumab-twza (FGF23; Human IgG1), Lanadelumab, lanadelumab-flyo (Plasma kallikrelin; Human IgG1), Mogamulizumab, mogamulizumab-kpkc (CCR4; Humanized IgG1), Tildrakizumab; tildrakizumab-asmn (IL-23 p19; Humanized IgG1), Fremanezumab, fremanezumab-vfrm (CGRP; Humanized IgG2), Ravulizumab, ravulizumab-cwvz (C5; Humanized IgG2/4), Cemiplimab, cemiplimab-rwlc (PD-1; Human mAb), Ibalizumab, ibalizumab-uiyk (CD4; Humanized IgG4), Emapalumab, emapalumab-lzsg (IFNg; Human IgG1), Moxetumomab pasudotox, moxetumomab pasudotox-tdfk (CD22; Murine IgG1 dsFv immunotoxin), Caplacizumab, caplacizumab-yhdp (von Willebrand factor; Humanized Nanobody), Risankizumab, risankizumab-rzaa (IL-23 p19; Humanized IgG1), Polatuzumab vedotin, polatuzumab vedotin-piiq (CD79b; Humanized IgG1 ADC), Romosozumab, romosozumab-aqqg (Sclerostin; Humanized IgG2), Brolucizumab, brolucizumab-dbll (VEGF-A; Humanized scFv), Crizanlizumab; crizanlizumab-tmca (CD62 (aka P-selectin); Humanized IgG2), Enfortumab vedotin, enfortumab vedotin-ejfv (Nectin-4; Human IgG1 ADC), [fam-]trastuzumab deruxtecan, fam-trastuzumab deruxtecan-nxki (HER2; Humanized IgG1 ADC), Teprotumumab, teprotumumab-trbw (IGF-1R; Human IgG1), Eptinezumab, eptinezumab-jjmr (CGRP; Humanized IgG1), Isatuximab, isatuximab-irfc (CD38; Chimeric IgG1), Sacituzumab govitecan; sacituzumab govitecan-hziy (TROP-2; Humanized IgG1 ADC), Inebilizumab (CD19; Humanized IgG1), Leronlimab (CCR5; Humanized IgG4), Satralizumab (IL-6R; Humanized IgG2), Narsoplimab (MASP-2, Human IgG4), Tafasitamab (CD19; Humanized IgG1), REGNEB3 (Ebola virus; mixture of 3 human IgG1), Naxitamab (GD2;

Humanized IgG1), Oportuzumab monatox (EpCAM; Humanized scFv immunotoxin), Belantamab mafodotin (B-cell maturation antigen; Humanized IgG1 ADC), Margetuximab (HER2; Chimeric IgG1), Tanezumab (Nerve growth factor; Humanized IgG2), Dostarlimab (TSR-042) (PD-1; Humanized IgG4), Teplizumab (CD3; Humanized IgG1), Aducanumab (Amyloid beta; Human IgG1), Sutimlimab (BIVV009) (C1s; Humanized IgG4), Evinacumab (Angiopoietin-like 3; Human IgG4).

The combination treatment with any of these further therapeutic antibodies is preferred in particular for a tumor specifically expressing the target of the selected further therapeutic antibody.

According to some embodiments E of the third embodiments according to the $22^{nd}$ aspect, the one or more further therapeutically active compounds comprise(s) a further therapeutic antibody targeting CD16a, ILDR2, PSMA or Mesothelin.

Combination with Cytotoxic or Cytostatic Agents

Several chemotherapeutics such as doxorubicin and oxaliplatin induce immunogenic cell death (ICD). ICD however was found to be related to the response to anti-CCR8 antibodies, such that a combination therapy can add further benefit to the application of monotherapy.

According to some embodiments F of the third embodiments according to the $22^{nd}$ aspect, the one or more further therapeutically active compounds comprise(s) a cytostatic agent selected from radionuclides, alkylating agents, DNA cross-linking agents, DNA intercalating agents (e.g., groove binding agents such as minor groove binders), cell cycle modulators, apoptosis regulators, kinase inhibitors, protein synthesis inhibitors, mitochondria inhibitors, nuclear export inhibitors, topoisomerase I inhibitors, topoisomerase II inhibitors, RNA/DNA antimetabolites and antimitotic agents.

Alkylating Agent

According to some embodiments F1 of the third embodiments according to the $22^{nd}$ aspect, the one or more further therapeutically active compounds comprise(s) an alkylating agent selected from asaley (L-Leucine, N—[N-acetyl-4-[bis-(2-chloroethyl)amino]-DL-phenylalanyl]-, ethylester); AZQ (1,4-cyclohexadiene-1,4-dicarbamic acid, 2, 5-bis(1-aziridinyl)-3,6-dioxo-, diethyl ester); BCNU (N,N'-Bis(2-chloroethyl)-N-nitrosourea); busulfan (1,4-butanediol dimethanesulfonate); (carboxyphthalato)platinum; CBDCA (cis-(1,1-cyclobutanedicarboxylato)diammineplatinum(II))); CCNU (N-(2-chloroethyl)-N'-cyclohexyl-N-nitrosourea); CHIP (iproplatin; NSC 256927); chlorambucil; chlorozotocin (2-[[[(2-chloroethyl) nitrosoamino]carbonyl]amino]-2-deoxy-D-glucopyranose); cis-platinum (cisplatin); clomesone; cyanomorpholinodoxorubicin; cyclodisone; dianhydrogalactitol (5,6-diepoxydulcitol); fluorodopan ((5-[(2-chloroethyl)-(2-fluoroethyl)amino]-6-methyl-uracil); hepsulfam; hycanthone; indolinobenzodiazepine dimer DGN462; melphalan; methyl CCNU ((1-(2-chloroethyl)-3-(trans-4-methylcyclohexane)-1-nitrosourea); mitomycin C; mitozolamide; nitrogen mustard ((bis(2-chloroethyl) methylamine hydrochloride); PCNU ((1-(2-chloroethyl)-3-(2,6-dioxo-3-piperidyl)-1-nitrosourea)); piperazine alkylator ((1-(2-chloroethyl)-4-(3-chloropropyl)-piperazine dihydrochloride)); piperazinedione; pipobroman (N,N'-bis (3-bromopropionyl) piperazine); porfiromycin (N-methylmitomycin C); spirohydantoin mustard; teroxirone (triglycidylisocyanurate); tetraplatin; thio-tepa (N,N',N"-tri-1,2-ethanediylthio phosphoramide); triethylenemelamine; uracil nitrogen mustard (desmethyldopan); Yoshi-864 ((bis(3-mesyloxy propyl)amine hydrochloride).

DNA Alkylating-Like Agent

According to some embodiments F2 of the third embodiments according to the $22^{nd}$ aspect, the one or more further therapeutically active compounds comprise(s) an DNA alkylating-like agent selected from Cisplatin; Carboplatin; Nedaplatin; Oxaliplatin; Satraplatin; Triplatin tetranitrate; Procarbazine; altretamine; dacarbazine; mitozolomide; temozolomide.

Alkylating Antineoplastic Agent

According to some embodiments F3 of the third embodiments according to the $22^{nd}$ aspect, the one or more further therapeutically active compounds comprise(s) an alkylating antineoplastic agent selected from Carboquone; Carmustine; Chlornaphazine; Chlorozotocin; Duocarmycin; Evofosfamide; Fotemustine; Glufosfamide; Lomustine; Mannosulfan; Nimustine; Phenanthriplatin; Pipobroman; Ranimustine; Semustine; Streptozotocin; ThioTEPA; Treosulfan; Triaziquone; Triethylenemelamine; Triplatin tetranitrate.

DNA Replication and Repair Inhibitor

According to some embodiments F4 of the third embodiments according to the $22^{nd}$ aspect, the one or more further therapeutically active compounds comprise(s) a DNA replication and repair inhibitor selected from Altretamine; Bleomycin; Dacarbazine; Dactinomycin; Mitobronitol; Mitomycin; Pingyangmycin; Plicamycin; Procarbazine; Temozolomide; ABT-888 (veliparib); olaparib; KU-59436; AZD-2281; AG-014699; BSI-201; BGP-15; INO-1001; ONO-2231.

Cell Cycle Modulator

According to some embodiments F5 of the third embodiments according to the $22^{nd}$ aspect, the one or more further therapeutically active compounds comprise(s) a cell cycle modulator, such as Paclitaxel; Nab-Paclitaxel; Docetaxel; Vincristine; Vinblastine; ABT-348; AZD-1152; MLN-8054; VX-680; Aurora A-specific kinase inhibitors; Aurora B-specific kinase inhibitors and pan-Aurora kinase inhibitors; AZD-5438; BMI-1040; BMS-032; BMS-387; CVT-2584; flavopyridol; GPC-286199; MCS-5A; PD0332991; PHA-690509; seliciclib (CYC-202, R-roscovitine); ZK-304709; AZD4877, ARRY-520: GSK923295A.

Apoptosis Regulator

According to some embodiments F6 of the third embodiments according to the $22^{nd}$ aspect, the one or more further therapeutically active compounds comprise(s) an apoptosis regulator such as AT-101 ((-)gossypol); G3139 or oblimersen (Bcl-2-targeting antisense oligonucleotide); IPI-194; IPI-565; N-(4-(4-((4'-chloro(1,1'-biphenyl)-2-yl) methyl)piperazin-1-ylbenzoyl)-4-(((1R)-3-(dimethylamino)-1-((phenylsulfanyl)methyl)propyl)amino)-3-nitrobenzenesulfonamide); N-(4-(4-((2-(4-chlorophenyl)-5, 5-dimethyl-1-cyclohex-1-en-1-yl)methyl)piperazin-1-yl) benzoyl)-4-(((1R)-3-(morpholin-4-yl)-1-((phenylsulfanyl) methyl)propyl)amino)-3-((trifluoromethyl)sulfonyl)

benzenesulfonamide; GX-070 (Obatoclax®; 1H-Indole, 2-(2-((3,5-dimethyl-1H-pyrrol-2-yl)methylene)-3-methoxy-2H-pyrrol-5-yl)-)); HGS1029; GDC-0145; GDC-0152; LCL-161; LBW-242; venetoclax; agents that target TRAIL or death receptors (e.g., DR4 and DR5) such as ETR2-ST01, GDC0145, HGS-1029, LBY-135, PRO-1762; drugs that target caspases, caspase-regulators, BCL-2 family members, death domain proteins, TNF family members, Toll family members, and/or NF-kappa-B proteins.

Angiogenesis Inhibitor

According to some embodiments F7 of the third embodiments according to the $22^{nd}$ aspect, the one or more further therapeutically active compounds comprise(s) an angiogenesis inhibitor such as ABT-869; AEE-788; axitinib (AG-13736); AZD-2171; CP-547,632; IM-862; pegaptamib; sorafenib; BAY43-9006; pazopanib (GW-786034); vatalanib (PTK-787, ZK-222584); sunitinib; SU-11248; VEGF trap; vandetanib; ABT-165; ZD-6474; DLL4 inhibitors.

Proteasome Inhibitor

According to some embodiments F8 of the third embodiments according to the $22^{nd}$ aspect, the one or more further therapeutically active compounds comprise(s) a proteasome inhibitor such as Bortezomib; Carfilzomib; Epoxomicin; Ixazomib; Salinosporamide A.

Kinase Inhibitor

According to some embodiments F9 of the third embodiments according to the $22^{nd}$ aspect, the one or more further therapeutically active compounds comprise(s) a kinase inhibitor such as Afatinib; Axitinib; Bosutinib; Crizotinib; Dasatinib; Erlotinib; Fostamatinib; Gefitinib; Ibrutinib; Imatinib; Lapatinib; Lenvatinib; Mubritinib; Nilotinib; Pazopanib; Pegaptanib; Sorafenib; Sunitinib; SU6656; Vandetanib; Vemurafenib; CEP-701 (lesaurtinib); XL019; INCB018424 (ruxolitinib); ARRY-142886 (selemetinib); ARRY-438162 (binimetinib); PD-325901; PD-98059; AP-23573; CCI-779; everolimus; RAD-001; rapamycin; temsirolimus; ATP-competitive TORC1/TORC2 inhibitors including PI-103, PP242, PP30, Torin 1; LY294002; XL-147; CAL-120; ONC-21; AEZS-127; ETP-45658; PX-866; GDC-0941; BGT226; BEZ235; XL765, Regorafenib, and MEKi-1.

Protein Synthesis Inhibitor

According to some embodiments F10 of the third embodiments according to the $22^{nd}$ aspect, the one or more further therapeutically active compounds comprise(s) a protein synthesis inhibitor such as Streptomycin; Dihydrostreptomycin; Neomycin; Framycetin; Paromomycin; Ribostamycin; Kanamycin; Amikacin; Arbekacin; Bekanamycin; Dibekacin; Tobramycin; Spectinomycin; Hygromycin B; Paromomycin; Gentamicin; Netilmicin; Sisomicin; Isepamicin; Verdamicin; Astromicin; Tetracycline; Doxycycline; Chlortetracycline; Clomocycline; Demeclocycline; Lymecycline; Meclocycline; Metacycline; Minocycline; Oxytetracycline; Penimepicycline; Rolitetracycline; Tetracycline; Glycylcyclines; Tigecycline; Oxazolidinone; Eperezolid; Linezolid; Posizolid; Radezolid; Ranbezolid; Sutezolid; Tedizolid; Peptidyl transferase inhibitors; Chloramphenicol; Azidamfenicol; Thiamphenicol; Florfenicol; Pleuromutilins; Retapamulin; Tiamulin; Valnemulin; Azithromycin; Clarithromycin; Dirithromycin; Erythromycin; Flurithromycin; Josamycin; Midecamycin; Miocamycin; Oleandomycin; Rokitamycin; Roxithromycin; Spiramycin; Troleandomycin; Tylosin; Ketolides; Telithromycin; Cethromycin; Solithromycin; Clindamycin; Lincomycin; Pirlimycin; Streptogramins; Pristinamycin; Quinupristin/dalfopristin; Virginiamycin.

Histone Deacetylase Inhibitor

According to some embodiments F11 of the third embodiments according to the $22^{nd}$ aspect, the one or more further therapeutically active compounds comprise(s) a histone deacetylase inhibitor such as Vorinostat; Romidepsin; Chidamide; Panobinostat; Valproic acid; Belinostat; Mocetinostat; Abexinostat; Entinostat; SB939 (pracinostat); Resminostat; Givinostat; Quisinostat; thioureidobutyronitrile (Kevetrin™); CUDC-10; CHR-2845 (tefinostat); CHR-3996; 4SC-202; CG200745; ACY-1215 (rocilinostat); ME-344; sulforaphane.

Topoisomerase I Inhibitor

According to some embodiments F12 of the third embodiments according to the $22^{nd}$ aspect, the one or more further therapeutically active compounds comprise(s) a topoisomerase I inhibitor such as camptothecin; various camptothecin derivatives and analogs (for example, NSC 100880, NSC 603071, NSC 107124, NSC 643833, NSC 629971, NSC 295500, NSC 249910, NSC 606985, NSC 74028, NSC 176323, NSC 295501, NSC 606172, NSC 606173, NSC 610458, NSC 618939, NSC 610457, NSC 610459, NSC 606499, NSC 610456, NSC 364830, and NSC 606497); morpholinisoxorubicin; SN-38.

Topoisomerase II Inhibitor

According to some embodiments F13 of the third embodiments according to the $22^{nd}$ aspect, the one or more further therapeutically active compounds comprise(s) a topoisomerase II inhibitor such as doxorubicin; amonafide (benzisoquinolinedione); m-AMSA (4'-(9-acridinylamino)-3'-methoxymethanesulfonanilide); anthrapyrazole derivative ((NSC 355644); etoposide (VP-16); pyrazoloacridine ((pyrazolo[3,4,5-kl]acridine-2(6H)-propanamine, 9-methoxy-N, N-dimethyl-5-nitro-, monomethanesulfonate); bisantrene hydrochloride; daunorubicin; deoxydoxorubicin; mitoxantrone; menogaril; N,N-dibenzyl daunomycin; oxanthrazole; rubidazone; teniposide.

DNA Intercalating Agent

According to some embodiments F14 of the third embodiments according to the $22^{nd}$ aspect, the one or more further therapeutically active compounds comprise(s) a DNA intercalating agent such as anthramycin; chicamycin A; tomaymycin; DC-81; sibiromycin; pyrrolobenzodiazepine derivative; SGD-1882 ((S)-2-(4-aminophenyl)-7-methoxy-8-(3 S)-7-methoxy-2-(4-methoxyphenyl)-5-oxo-5,11a-dihydro-1H-benzo[e]pyrrolo[1,2-a][1,4]diazepin-8-yl)oxy) propoxy)-1H-benzo[e]pyrrolo[1,2-a][1,4]diazepin-5(11aH)-one); SG2000 (SJG-136; (11aS,11a'S)-8,8'-(propane-1,3-diylbis(oxy))bis(7-methoxy-2-methylene-2,3-dihydro-1H-benzo[e]pyrrolo[1,2-a][1,4]diazepin-5(11aH)-one)).

RNA/DNA Antimetabolite

According to some embodiments F15 of the third embodiments according to the $22^{nd}$ aspect, the one or more further therapeutically active compounds comprise(s) a RNA/DNA antimetabolite such as gemcitabine, L-alanosine; 5-azacytidine; 5-fluorouracil; acivicin; aminopterin derivative N-[2-chloro-5[[(2, 4-diamino-5-methyl-6-quinazolinyl)methyl]amino]benzoyl]L-aspartic acid (NSC 132483); aminopterin derivative N-[4-[[(2, 4-diamino-5-ethyl-6-quinazolinyl)methyl]amino]benzoyl]L-aspartic acid; aminopterin derivative N-[2-chloro-4-[[(2, 4-diamino-6-pteridinyl)methyl]amino]benzoyl]L-aspartic acid monohydrate; antifolate PT523 ((Nα-(4-amino-4-deoxypteroyl)-Nγ-hemiphthaloyl-L-ornithine)); Baker's soluble antifol (NSC 139105); dichlorallyl lawsone ((2-(3, 3-dichroallyl)-3-hydroxy-1,4-naphthoquinone); brequinar; ftorafur ((pro-drug; 5-fluoro-1-(tetrahydro-2-furyl)-uracil); 5,6-dihydro-5-azacytidine; methotrexate; methotrexate derivative (N-[[4-[[(2, 4-diamino-6-pteridinyl)methyl]methylamino]-1-naphthalenyl]carbonyl]L-glutamic acid); PALA ((N-(phosphonoacetyl)-L-aspartate); pyrazofurin; trimetrexate.

DNA Antimetabolite

According to some embodiments F16 of the third embodiments according to the $22^{nd}$ aspect, the one or more further therapeutically active compounds comprise(s) a DNA antimetabolite such as 3-HP; 2'-deoxy-5-fluorouridine; 5-HP; α-TGDR (α-2'-deoxy-6-thioguanosine); aphidicolin glycinate; ara C (cytosine arabinoside); 5-aza-2'-deoxycytidine; β-TGDR (β-2'-deoxy-6-thioguanosine); cyclocytidine; guanazole; hydroxyurea; inosine glycodialdehyde; macbecin II; pyrazoloimidazole; thioguanine; thiopurine.

Mitochondria Inhibitor

According to some embodiments F17 of the third embodiments according to the $22^{nd}$ aspect, the one or more further therapeutically active compounds comprise(s) a mitochondria inhibitor such as pancratistatin; phenpanstatin; rhodamine-123; edelfosine; d-alpha-tocopherol succinate; compound 11β; aspirin; ellipticine; berberine; cerulenin; GX015-070 (Obatoclax®; 1H-Indole, 2-(2-((3,5-dimethyl-1H-pyrrol-2-yl)methylene)-3-methoxy-2H-pyrrol-5-yl)-); celastrol (tripterine); metformin; Brilliant green; ME-344.

Antimitotic Agent

According to some embodiments F18 of the third embodiments according to the $22^{nd}$ aspect, the one or more further therapeutically active compounds comprise(s) an antimitotic agent such as allocolchicine; auristatins, such as MMAE (monomethyl auristatin E) and MMAF (monomethyl auristatin F); halichondrin B; cemadotin; colchicine; cholchicine derivative (N-benzoyl-deacetyl benzamide); dolastatin-10; dolastatin-15; maytansine; maytansinoids, such as DM1 (N2'-deacetyl-N2'-(3-mercapto-1-oxopropyl)-maytansine); rhozoxin; paclitaxel; paclitaxel derivative ((2'-N-[3-(dimethylamino)propyl]glutaramate paclitaxel); docetaxel; thiocolchicine; trityl cysteine; vinblastine sulfate; vincristine sulfate.

Nuclear Export Inhibitor

According to some embodiments F19 of the third embodiments according to the $22^{nd}$ aspect, the one or more further therapeutically active compounds comprise(s) a nuclear export inhibitor such as callystatin A; delactonmycin; KPT-185 (propan-2-yl (Z)-3-[3-[3-methoxy-5-(trifluoromethyl)phenyl]-1,2,4-triazol-1-yl]prop-2-enoate); kazusamycin A; leptolstatin; leptofuranin A; leptomycin B; ratjadone; Verdinexor ((Z)-3-[3-[3,5-bis(trifluoromethyl)phenyl]-1,2,4-triazol-1-yl]-N-pyridin-2-ylprop-2-enehydrazide).

Hormonal Therapeutics

According to some embodiments F20 of the third embodiments according to the $22^{nd}$ aspect, the one or more further therapeutically active compounds comprise(s) a hormonal therapeutics such as anastrozole; exemestane; arzoxifene; bicalutamide; cetrorelix; degarelix; deslorelin; trilostane; dexamethasone; flutamide; raloxifene; fadrozole; toremifene; fulvestrant; letrozole; formestane; glucocorticoids; doxercalciferol; sevelamer carbonate; lasofoxifene; leuprolide acetate; megesterol; mifepristone; nilutamide; tamoxifen citrate; abarelix; prednisone; finasteride; rilostane; buserelin; luteinizing hormone releasing hormone (LHRH); Histrelin; trilostane or modrastane; fosrelin; goserelin. According to some embodiments G of the third embodiments according to the $22^{nd}$ aspect, the one or more further therapeutically active compounds comprise(s) an antibody targeting myeloid suppressive cells.

According to some embodiments H of the third embodiments according to the $22^{nd}$ aspect, the one or more further therapeutically active compounds comprise(s) agents that prime antigen presenting cells (APC), which in turn can activate T cells.

According to some embodiments I of the third embodiments according to the $22^{nd}$ aspect, the one or more further therapeutically active compounds comprise(s) a BiTE antibody. BiTE antibodies are bispecific antibodies that direct T-cells to attack cancer cells by simultaneously binding the two cells. The T-cell then attacks the target cell, i.e. the Treg. For example, a BiTE approach is complementary to the ADCC based approach of a naked CCR8 antibody.

Standard Therapy

According to some embodiments J of the third embodiments according to the $22^{nd}$ aspect, the combination is a combination with the standard of care for the tumor or the disease characterized by chemokine receptor positive, e.g. CCR8 positive cells. The standard of care can be the standard of care for any of T-cell acute lymphoblastic leukemia, breast cancer, triple-negative breast cancer, triple positive breast cancer, non-small cell lung cancer (NSCLC), testicular cancer, gastric cancer, head and neck squamous cell carcinoma, thymoma, esophageal adenocarcinoma, colorectal cancer, pancreatic adenocarcinoma, ovarian cancer or cervical cancer, acute myeloid leukemia, kidney cancer, bladder cancer, melanoma, thyroid cancer, mesothelioma, sarcoma and prostate cancer.

According to some preferred embodiments, the standard of care is the standard of care for the treatment of head and neck cancer, breast cancer, gastric cancer, lung cancer, squamous cell carcinoma, esophageal tumor, melanoma, bladder cancer, liver cancer, and/or prostate cancer. In case of doubt, the standard of care is defined as in the "S3 Leitlinie" for the respective tumor, e.g. Leitlinie Analkarzinom, Aktinische Keratose and Plattenepithelkarzinom der Haut, Chronische Lymphatische Leukämie (CLL), Endometriumkarzinom, Folliküläres Lymphom, Harnblasenkarzinom, Hautkrebs-Prävention, Hepatozellulares Karzinom (HCC), Hodentumoren, Hodgkin-Lymphom, Kolorektales Karzinom, Larynxkarzinom, Lungenkarzinom, Magenkarzinom, Mammakarzinom, Melanom, Mundhoehlenkarzinom, Nierenzellkarzinom, Ovarialkarzinom, Osophaguskarzinom, Palliativmedizin, Pankreaskarzinom, Peniskarzinom, Prostatakarzinom, Psychoonkologie, Supportive Therapie, Zervixkarzinom, being effective on 2020 Jun. 26, cf. www.leitlinienprogramm-onkologie.de/leitlinien, incorporated herein by reference in its entirety as available Jan. 6, 2021.

Radiation Therapy

According to some embodiments K of the third embodiments according to the $22^{nd}$ aspect, which may be and are suggested to be combined with the embodiments of the first and/or second embodiments according to the $22^{nd}$ aspect, the use is a use in simultaneous, separate, or sequential combination with radiation therapy.

For example, the radiation therapy may be a therapy involving a radiation scheme as known in the art, e.g. comprising external beam therapy by x-ray with a typical total dose of 40 Gy fractionated into 15 daily treatments or a total dose of 70 Gy fractionated to 37 daily treatments. For example, the radiation therapy may be brachytherapy. Example 12.6.8 shows a combination treatment with an anti-CCR8 antibody and radiotherapy.

NK Cell Therapy

According to some embodiments L of the third embodiments according to the $22^{nd}$ aspect, which may be and are suggested to be combined with the embodiments of the first and/or second embodiments according to the $22^{nd}$ aspect, the use is a use in simultaneous, separate, or sequential combination with NK cell therapy. The NK cell therapy can for example comprise the use of an engineered NK cell line as described in EP1771471 or can comprise the use of isolated primary NK cells, potentially including modifications such as a chimeric receptor, cf. WO2006052534.

Targeting Cell Surface Molecules Associated with T-Cell Activation

According to some embodiments M of the third embodiments of the $22^{nd}$ aspect, there is provided the antibody or antigen binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect, or a conjugate according to the $19^{th}$ aspect or the pharmaceutical composition according to the $20^{th}$ aspect for use in simultaneous, separate, or sequential combination with one or more further therapeutically active compounds targeting cell surface molecules associated with T-cell activation, selected from CD25, CTLA-4, PD-1, LAG3, TIGIT, ICOS, and TNF receptor super family members, 4-1BB, OX-40, and GITR.

B Cell Depletion

According to some embodiments N of the third embodiments according to the $22^{nd}$ aspect, which may be and are suggested to be combined with the embodiments of the first and/or second embodiments according to the $22^{nd}$ aspect, the use is a use in simultaneous, separate, or sequential combination with intra-tumoral B cell depletion. Intra-tumoral B cell depletion may occur by administration of an antibody or other molecule or any further treatment specifically targeting intra-tumoral B cells, preferably CD19+ B cells. Example 12.3.2 shows a treatment where an anti-CCR8 antibody was administered and intra-tumoral CD19+ B cells were depleted. While CD8+ T cell depletion abolished the beneficial effect of the treatment with an anti-CCR8 antibody, it was surprisingly found, that B cell depletion improved the beneficial effect of the treatment with an anti-CCR8 antibody. Without limitation, B cell depletion may occur by using an antibody targeting CD19 or CD20 or another suitable B cell marker.

Stratification/Prediction and Monitoring Schemes

The stratification steps described according to the following embodiments are also provided as stand-alone methods, e.g. for stratification, diagnosis, or monitoring of treatment success for an anti-CCR8 antibody treatment.

According to some fourth embodiments according to the $22^{nd}$ aspect, which may be and are suggested to be combined with the embodiments of the first, second and/or third embodiments according to the $22^{nd}$ aspect, the use comprises determining certain parameters to predict or monitor treatment success, e.g. for stratifying a group of subjects or patients to predict tumor response or to monitor treatment success. For example, the subjects may be human or non-human, such as mouse, rodent, or cynomolgus.

According to some embodiments A of the fourth embodiments according to the $22^{nd}$ aspect, the use comprises determining
a. presence or quantity of tumor infiltrating lymphocytes,
b. presence or quantity of macrophages and/or NK cells,
c. presence or quantity of CCR8 positive or FOXP3 positive regulatory T cells,
d. tumor mutational burden,
e. cancer staging,
f. presence, level or activation of interferon-stimulated genes or proteins,
g. CCR8 expression,
h. presence or quantity of complement factor proteins, serpins, and/or MHC components,
i. presence or quantity of cytokines, such as inflammatory or suppressive cytokines,
j. activation of immune gene expression,
k. immune checkpoint protein expression, such as PD-(L)1 or CTLA4 expression,
l. presence or quantity of tumor infiltrating CD19+ B cells, and/or
m. presence or quantity of tumor infiltrating CD8+ T cells, for stratifying a group of subjects or patients to predict tumor response, or for predicting or monitoring treatment success.

According to some embodiments A1 of the fourth embodiments according to the $22^{nd}$ aspect, the use comprises determining the presence or quantity of (a) tumor infiltrating lymphocytes, (b) macrophages and/or NK cells, and/or (c) CCR8 positive or FOXP3 positive regulatory T cells. Evaluation of presence or quantity of cell types such as (a) tumor infiltrating lymphocytes, (b) macrophages and/or NK cells, and/or (c) CCR8 positive regulatory T cells may occur using biopsy, such as skin biopsy, surgical biopsy, endoscopic biopsy or needle biopsy, such as fine-needle aspiration, core needle biopsy, vacuum-assisted biopsy, or image-guided biopsy and subsequent staining. The number or relative amount of (a) tumor infiltrating lymphocytes, (b) macrophages and/or NK cells, and/or (c) CCR8 positive regulatory T cells may then be compared to a reference, e.g. a reference sample or a reference value. The relative presence or quantity of (a) tumor infiltrating lymphocytes, (b) macrophages and/or NK cells, and/or (c) CCR8 positive regulatory T cells may be used to predict a favorable response to treatment with an antibody or fragment according to the current invention. In the alternative, a scoring system may be used, e.g. to determine the number or relative amount of tumor infiltrating lymphocytes, such as the scoring system described in Zhang, Dachuan, et al. "Scoring system for tumor-infiltrating lymphocytes and its prognostic value for gastric cancer." Frontiers in immunology 10 (2019): 71.

According to some embodiments A2 of the fourth embodiments according to the $22^{nd}$ aspect, the use comprises determining tumor mutational burden for predicting and monitoring tumor response. Tumor mutational burden (TMB) is a biomarker that measures the number of somatic mutations present in a cancer patient's tumor and is quantified as mutations per megabase (mut/Mb). This metric can be used in order to stratify patients, e.g. to predict or monitor response to treatment with an antibody or conjugate according to the current invention. FDA-approved tests exist and may be used e.g. with a reference value of ≥10 mut/Mb. In the alternative, microsatellite instability (MSI) may be used for stratification, which is caused by failure of the DNA mismatch repair system.

According to some embodiments A3 of the fourth embodiments according to the $22^{nd}$ aspect, the use comprises determining cancer staging for predicting and monitoring tumor response. Cancer staging may be performed as known in the art, e.g. using the TNM classification system or the FIGO staging, and may be used in order to stratify patients, e.g. to predict or monitor response to treatment with an antibody or conjugate according to the current invention.

According to some embodiments A4 of the fourth embodiments according to the $22^{nd}$ aspect, the use comprises determining presence, level or activation of interferon or interferon-stimulated genes or proteins for predicting and monitoring tumor response. An interferon-stimulated gene is a gene whose expression is stimulated by interferon, in particular by IFNg. Suitable interferon-stimulated genes or proteins include without limitation ACOD1, ACTG1, ACTR2, ACTR3, ADAMTS13, AIF1, AQP4, ASS1, B2M, BST2, C9JQL5, CALCOCO2, CAMK2A, CAMK2B, CAMK2D, CAMK2G, CASP1, CCL1, CCL11, CCL13, CCL14, CCL15, CCL15, CCL14, CCL16, CCL17, CCL18, CCL19, CCL2, CCL20, CCL21, CCL22, CCL23, CCL24, CCL25, CCL26, CCL3, CCL3L1, CCL4, CCL4L1, CCLS, CCL7, CCL8, CD40, CD44, CD58, CDCl42EP2, CDCl42EP4, CIITA, CITED1, CLDN1, CX3CL1, CXCL16, CYP27B1 DAPK1, DAPK3, EDN1, EPRS, EVL, FCGR1A, FCGR1B, FLNB, GAPDH, GBP1, GBP2, GBP4, GBP5, GBP6, GCH1, GSN, HCK, HLA-A, HLA-B, HLA-C, HLA-DPA1, HLA-DPB1, HLA-DQA1, HLA-DQA2, HLA-DQB1, HLA-DQB2, HLA-DRA HLA-DRB1, HLA-DRB3, HLA-DRB4, HLA-DRB5, HLA-E, HLA-F, HLA-G, HLA-H, ICAM1, IFI30, IFITM1, IFITM2, IFITM3, IFNG, IFNGR1, IFNGR2, IL12B, IL12RB1 IL23R, IRF1, IRF2, IRF3, IRF4, IRF5, IRF6, IRF7, IRF8, IRF9, JAK1, JAK2, KIF16B, KIF5B, KYNU, LGALS9, MEFV, MID1, MRC1, MT2A, MYO1C, NCAM1, NMI, NOS2, NUB1, OAS1, OAS2, OAS3, OASL, PDE12, PML, PRKCD, PTAFR, RAB12, RAB20, RAB43, RAB7B, RPL13A, RPS6KB1 RYDEN, SEC61A1 SLC11A1 SLC26A6 SLC30A8 SNCA, SP100, STAR, STAT1, STX4, STX8, STXBP1, STXBP2, STXBP3, STXBP4, SYNCRIP TDGF1, TLR2, TLR3, TLR4, TRIM21, TRIM22, TRIM25, TRIM26, TRIM31, TRIM34, TRIM38, TRIMS, TRIM62, TRIM68, TRIMS, UBD, VAMP3, VCAM1, VIM, VPS26B, WAS, WNTSA, XCL1, XCL2, ZYX.

According to some embodiments A5 of the fourth embodiments according to the $22^{nd}$ aspect, the use comprises determining CCR8 expression for predicting and monitoring tumor response. CCR8 expression levels may be determined, e.g. based on biopsy samples, as known in the art, e.g. using IHC, PCR or ELISA based methods, for example using an antibody, fragment or conjugate as disclosed herein.

According to some embodiments A6 of the fourth embodiments according to the $22^{nd}$ aspect, the use comprises determining presence, level or activation of genes or proteins selected from (a) complement factor proteins, (b) serpins, (c) MHC components or (d) Arg2 or (e) another biomarker disclosed herein (see e.g. example 12.7.1 or 12.7.2) for predicting and monitoring tumor response. Suitable complement factor proteins include without limitation C1R, CIS, C4A, C5ar2, F12, and MASP2, or their analogues from the respective species for treatment. Suitable serpins include without limitation Serpina1a, Serpina1b, Serpina1d, Serpina3i, or their analogues from other species. Suitable MHC components include without limitation H2-K2, H2-T24, H2-Q10, H2-B1, H2-Q1, H2-Q5, and H2-DMb2, or their analogues from other species.

As discussed in example 12.1.2, the inventors found based on genome wide RNA-seq data of early tumors from syngeneic mouse models, that increased levels of the following genes strongly correlated with tumor response: Eif3j2, Eno1b, Ifi441, Hist1h2a1, Ifi202b, Hmga1b, Amd2, Sycp1, Itln1, Trim34b, Catsperg2, Zfp868, Serpina1b, Prss41, Clrb, Cyld, Ccnblip1, Masp2, Acaa1b, C4a, Snord93, Abhd1, Serpina3h, H2-K2, Cd1d2, Hal, Rnf151, Rbm46, Arg2, Mir8099-2, Igsf21, Olfr373, Cls2, Crym, Arv1, Hddc3, Plppr4, Ppplr11, Rps3a2, Zfp459, Rnd1, Serpina1a, Vcpkmt, Atp10d, Gbp2b, H2-T24, Tlcd2, Ctse, H2-Q10, Cyp2c55, Borcs8, Tpsab1, Trim43b, Cc2d1a, Serpina1d, Cacna1a, Kcnj14, Ttc13, Farsa, Olfr1217, Jam1, H2-B1, Tnpo2, Rims3, Dock9, Car5b, Atpla4, H2-Q1, Zfp69, Slpi, Pcdhgb8, Oce11, Selenbp2, Nsd3, Wt1, Nap1l2, Ranbp9, Gtpbp3, AY761185, Rnaset2a, Serpina3i, E112, Gal3st2b, Urb2, F12, Klk1, Ifi214, Cstl1, Agtpbp1, Msh5, Cox18, Zfp330, Ttc37, Klk4, H2-Q5, Cxcl11, Rab39, Pm20d1, Nod2, H2-DMb2. Interestingly, this set is highly enriched for early complement factors, complement regulating factors such as Serpins, and MHC components. In particular, the presence of high levels of Complement C1/C4 might contribute to Treg lysis. Where depletion/consumption of complement factors reduces the efficacy of Treg depletion, supplementing the complement system, e.g. in a combination treatment may be an option.

According to some preferred embodiments of the fourth embodiments according to the $22^{nd}$ aspect, the use comprises determining the presence, level or activation of genes or proteins selected from Eif3j2, Eno1b, Ifi441, Hist1h2al, Ifi202b, Hmga1b, Amd2, Sycp1, Itln1, Trim34b, Catsperg2, Zfp868, Serpina1b, Prss41, Clrb, Cyld, Ccnblip1, Masp2, Acaa1b, C4a, Snord93, Abhd1, Serpina3h, H2-K2, Cd1d2, Hal, Rnf151, Rbm46, Arg2, Mir8099-2, Igsf21, Olfr373, Cls2, Crym, Arv1, Hddc3, Plppr4, Ppplr11, Rps3a2, Zfp459, Rnd1, Serpina1a, Vcpkmt, Atp10d, Gbp2b, H2-T24, Tlcd2, Ctse, H2-Q10, Cyp2c55, Borcs8, Tpsab1, Trim43b, Cc2d1a, Serpina1d, Cacna1a, Kcnj14, Ttc13, Farsa, Olfr1217, Jam1, H2-B1, Tnpo2, Rims3, Dock9, Car5b, Atpla4, H2-Q1, Zfp69, Slpi, Pcdhgb8, Oce11, Selenbp2, Nsd3, Wt1, Nap1l2, Ranbp9, Gtpbp3, AY761185, Rnaset2a, Serpina3i, E112, Gal3st2b, Urb2, F12, Klk1, Ifi214, Cstl1, Agtpbp1, Msh5, Cox18, Zfp330, Ttc37, Klk4, H2-Q5, Cxcl11, Rab39, Pm20d1, Nod2, H2-DMb2 or any combination thereof for predicting and monitoring tumor response. As immediately understood by the skilled person, for a human subject, the stratification, prediction or monitoring method comprises determining the presence, level or activation of the human counterparts of the provided genes or proteins.

According to some embodiments A7 of the fourth embodiments according to the 22$^{nd}$ aspect, the use comprises determining presence or quantity of inflammatory or suppressive cytokines for predicting and monitoring tumor response. Evaluation of presence or quantity of inflammatory or suppressive cytokines may occur as known in the art.

According to some embodiments A8 of the fourth embodiments according to the 22$^{nd}$ aspect, the use comprises predicting or monitoring tumor response based on the activation of immune gene expression. Measuring the activation of immune gene expression may occur using a method known in the art, e.g. using gene set enrichment analysis or using a marker-based assay known in the art. Furthermore, stratifying, predicting or monitoring may occur based on a gene signature characteristic for activated Tregs or immune cells.

According to some highly preferred embodiments A9 of the fourth embodiments according to the 22" aspect, the use comprises stratifying a group of subjects or patients to predict tumor response based on immune checkpoint protein expression, such as PD-L1 expression, PD-1 expression or CTLA4 expression, or the use comprises determining immune checkpoint protein expression levels, such as PD-L1 expression, PD-1 expression or CTLA4 expression for predicting and monitoring tumor response. Programmed death-ligand 1 (PD-L1) is an immune-related biomarker that can be expressed on the surface of many tissue types, including tumor cells. PD-L1 protein expression can be determined by using Tumor Proportion Score (TPS) or Combined Positive Score (CPS). According to the current invention it was surprisingly found that the response to (mono) therapy with anti-CCR8 antibody was improved for subjects having an ICI-responsive tumor and in particular a tumor with (high) PD-L1 expression (cf. example 12.7). Following up on this observation, the inventors found that infiltration with FoxP3+ Treg cells was likewise associated with high PD-L1 expression. The inventors therefore suggest PD-L1 as a surrogate marker for stratification to overcome the problem that CCR8 is difficult to analyze and therefore cannot be easily used to select subject populations that could most likely benefit from anti-CCR8 antibody treatment. In particularly preferred embodiments, PD-L1 expression is determined based on CPS or TPS. A subject or patient is determined as eligible for treatment with an anti-CCR8 antibody, if PD-L1 expression is present or high, e.g. as indicated by a CPS≥1, preferably by a CPS≥5, most preferably by a CPS≥10, or as indicated by a TPS≥1%, preferably by a TPS≥10%, most preferably by a TPS≥50%.

Aspect 23—Further and Diagnostic Uses

The anti-chemokine receptor or anti-CCR8 antibodies, fragments and conjugates as described herein may be used for a variety of purposes, such as to assist purification or immobilization of chemokine receptor or CCR8 expressing cells, such as activated or intra-tumoral Tregs, for in vitro, in vivo and ex vivo applications or diagnostics. As a specific example, the antibodies can be used in immunoassays for qualitatively and/or quantitatively measuring levels of chemokine receptors or chemokine receptor expressing cells in biological samples, see, e.g., Harlow et al., Antibodies: A Laboratory Manual, Second Edition (Cold Spring Harbor Laboratory Press, 1988).

For example, anti-chemokine receptor antibodies, anti-CCR8 antibodies or antigen-binding fragments thereof can be used for detecting the presence of chemokine receptor- or CCR8-expressing tumors. The presence or level of chemokine receptor- or CCR8-expressing cells or shed chemokine receptor or CCR8 within various biological samples, including serum, and tissue biopsy specimens, may be analyzed. In addition, anti-chemokine receptor or anti-CCR8 antibodies may be used in various imaging methodologies such as immunoscintigraphy with a 99Tc (or a different isotope) conjugated antibody. For example, an imaging protocol similar to the one described using a 111In conjugated anti-PSMA antibody may be used to detect cancer (Sodee, D. Bruce, et al. "Preliminary Imaging Results Using In-111 Labeled CYT-356 (Prostascintst) in the Detection of Recurrent Prostate Cancer." Clinical nuclear medicine 21.10 (1996): 759-767.). Another method of detection that can be used is positron emitting tomography, e.g. by conjugating the antibodies of the invention with a suitable isotope (see Herzog, Hans, et al. "Measurement of pharmacokinetics of yttrium-86 radiopharmaceuticals with PET and radiation dose calculation of analogous yttrium-90 radiotherapeutics." Journal of Nuclear Medicine 34.12 (1993): 2222-2226.).

According to a 23th aspect, there is provided the antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect for use in diagnostic applications or diagnosis.

In some first embodiments of the 23th aspect, there is provided an antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect for use in a method of diagnosis in vivo. The use may be a use for the diagnosis of a tumor or a disease characterized by chemokine receptor positive cells, e.g. CCR8 positive cells, such as CCR8 positive regulatory T cells. For example, the tumor or the disease characterized by chemokine receptor positive cells, is selected from T-cell acute lymphoblastic leukemia, breast cancer, triple-negative breast cancer, triple positive breast cancer, non-small cell lung cancer (NSCLC), small cell lung cancer (SCLC) testicular cancer, gastric cancer, head and neck squamous cell carcinoma, thymoma, esophageal adenocarcinoma, colorectal cancer, pancreatic adenocarcinoma, ovarian cancer or cervical cancer, acute myeloid leukemia, kidney cancer, bladder cancer, skin cancer, melanoma, thyroid cancer, mesothelioma, sarcoma and prostate cancer. According to some preferred embodiments, the use in a method of diagnosis in vivo is the use in the diagnosis of head and neck cancer, breast cancer, gastric cancer, lung cancer, squamous cell carcinoma, esophageal tumor, melanoma, bladder cancer, liver cancer, and/or prostate cancer, or any other tumor described herein.

According to some preferred embodiments, the antibody or antigen binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect or the pharmaceutical composition according to the 20$^{th}$ aspect is used for the stratification of subjects or patients for treatment, e.g. for the treatment of a disease described herein.

Aspect 24—DNA/RNA for CCR8 Antibody

According to a 24$^{th}$ aspect, there is provided a polynucleotide encoding an antibody or antigen-binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$16$^{th}$, 17$^{th}$ and/or 18$^{th}$ aspect. Preferably the polynucleotide according to this aspect is a polynucleotide as provided according to the sequence listing.

Aspect 25—Vector for Antibody

According to a 25th aspect, there is provided a vector comprising a polynucleotide according to the $24^{th}$ aspect. Various suitable vector systems are known in the art or described herein.

Aspect 26—Production Cell for Antibody

According to a $26^{th}$ aspect, there is provided an isolated cell arranged for production of an antibody or antigen-binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect. Preferably the isolated cell according to the current aspect is an eukaryotic cell, such as a CHO or HEK cell comprising a vector according to the $25^{th}$ aspect. In another preferred embodiment, the cell is a rat myeloma YB2/0 cell.

Aspect 27—Production Method for Antibody

According to a $27^{th}$ aspect, there is provided a method of producing an antibody or antigen-binding fragment according to the $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ and/or $18^{th}$ aspect, or a conjugate according to the $19^{th}$ aspect, comprising culturing a cell according to the $26^{th}$ aspect and optionally purification of the antibody or antigen-binding fragment. In some highly preferred embodiments, the method comprises afucosylation of the antibody as described elsewhere herein. In some embodiments, the method comprises purification of the antibody.

For example, the antibody according to the present invention may be purified by the purification process described in the following. The purification process described is suitable for a wide range of monoclonal IgG antibodies and is optimized for bioreactor titers up to 8 g/L with an expected harvest volume of e.g. 2000 L from a single-use or stainless-steel bioreactor. With appropriate modifications, antibody cultures with other titer ranges can be processed. Cell cultures are harvested and clarified via depth filtration and/or charged filtration. Clarified harvest is stored in single-use bags or in a stainless-steel storage tank with optional cooling.

General Process Conditions

Closed processing and single-use systems are preferred; stainless-steel skids or systems are also possible with appropriate cleaning and change-over procedures. Single-use bags are typically of low-density or ultra-low density polyethylene as contact layer. Among others, Sodium Acetate/Acetic Acid or Tris/Tris-HCl buffer systems may be used, usually in a total concentration of 50 mM and including 50 mM NaCl, unless otherwise noted. Buffers and process intermediates of the respective unit operations (e.g. Load, Eluate or Flowthrough) are usually 0.2 μm filtered inline or with a filtration assembly, using e.g. PES membrane and/or fleece filters. These solutions are usually stored in single-use bags or stainless-steel vessels, at ambient (e.g. 18-26° C.) or 2-8° C. conditions.

Capture

Antibody capture is performed using Protein A-based chromatography, utilizing e.g. Cytiva MabSelect SuRe, MabSelect SuRe LX, Mab Select PrismA or Purolite A50 resins. Loading is conducted following clarification, with or without pre-concentration by ultrafiltration. The loading density is typically 45-75 g/L, using a single or a variable flow rate to apply the clarified harvest onto the column (120-400 cm/h). The chromatography can be performed in batch mode with one or more columns, or in continuous (MCC (multi-column chromatography)/SMB (simulated moving bed)) mode with up to 8 columns. Pre- or self-packed columns are used with a typical bed height of 20 cm for batch mode. For continuous mode, a contact time of the clarified harvest to the resin of 1-4 min is targeted. The capture is performed in one or multiple cycles depending on the antibody titer. Prior to loading, the column is equilibrated using a Tris buffer (e.g. pH 7); washing is performed with at least two washing steps; high NaCl concentration in the first wash buffer, then low NaCl concentration in the second buffer (e.g. 1st wash: 1 M NaCl, pH 5.5; 2nd wash: 50 mM NaCl, pH 6.0) in acetate buffer. Elution may for instance be achieved by low pH (e.g. 3.5) acetate buffer containing 0-50 mM NaCl in typically ≤5 column volumes (CV) with UV- or volume-controlled eluate collection. The eluates may be pooled and well mixed at this step or after virus inactivation. The affinity column is regenerated by ≥3 CV acetic acid (e.g. 0.1 M, incl. 500 mM NaCl), sanitization (clean-in-place, CIP) occurs with 0.5-1.0 M NaOH for 30 min, re-equilibration with ≥4 CV. The column is stored in e.g. 20% EtOH or 2% BnOH.

Alternatively, affinity capture from clarified harvest can be performed with affinity ligands on a cellulose architecture (e.g. Fibro PrismA) using the same loading schemes and buffer system as outlined above. Regeneration or CIP block may be skipped for optimal processing time. A contact time of 5-20 seconds can be applied to Fibro units of varying sizes (e.g. 0.4 mL to 2.4 L). Typically, a loading capacity of 25-35 g/L unit volume can be realized. A single unit can be used to process a single batch or multiple batches, depending on the Fibro unit and bioreactor sizes as well as titer of antibody culture. Affinity loading materials can be further clarified by charged filters at >300 L/m2 throughput prior to loading to maximize lifetime use and to minimize fouling.

Low-pH Virus Inactivation

The capture eluate is adjusted with HOAc or HCl to pH 3.7-3.9 and held for 120-240 min in the same or a separate bag at ≥18° C. to inactivate potentially present viruses. Alternatively, viral inactivation is carried out at pH 3.4-3.6 for >30 minutes. The process intermediate is then adjusted to storage or to further processing conditions, e.g. to pH 4-7 using 1-2 M Tris/-HCl titrant stock.

Polishing 1

The antibody is further polished by anion exchange chromatography (AEX), typically in the form of membrane capsule or cassettes (e.g. Sartorius Sartobind STIC PA 4 mm or 3M MA ST Polisher) in flow-through mode, with flow rates ≤350 MV/h, for removal of process-related and/or product-related impurities and particles. The entire amount from one batch may be processed in one or in multiple cycles, depending on the antibody amount. Prior to loading, the intermediate is adjusted to a target conductivity of e.g. 8-20 mS/cm, and a target pH of e.g. 7.0 for antibodies with basic isoelectric points. For antibodies with an isoelectric point lower than pH 7.0, the conductivity could be 5-20 mS/cm, and the pH can be between its isoelectric point and pH 5.0 The membrane is equilibrated with Tris buffer, pH 7.0 or Acetate buffer pH 5-6, and loaded with densities between typically 0.5-10 g antibody/mL membrane volume (MV). A chase with equilibration buffer may be performed and combined with the collected flow-through, the collection criteria of which is controlled by e.g. UV or volume. The membrane adsorber may be used once or multiple times, for which it is regenerated (1 M NaCl for 25 MV) and, re-equilibrated (Tris buffer pH 7.0).

Polishing 2

Final polishing may for instance be achieved by cation exchange chromatography (CEX). In principle, the order of AEX and CEX unit operations may be reversed. The CEX unit operation is usually performed in bind & elute mode with flow rates between 100-200 cm/h. Pre- or self-packed columns with resins e.g. Cytiva Capto S ImpAct or Capto SP ImpRes may be used at 20 cm bed height. The polishing step is performed in one or multiple cycles depending on the antibody amount. If needed, the load may be adjusted to target conductivities between 5-9 mS/cm and to pH 4.5-7.5 with HOAc, Tris titrants or WFI. The load is applied at typical densities between 40-105 g/L onto a CEX column equilibrated with ≥5 CV acetate buffer (pH and conductivity matched to CEX load) and washed afterwards using ≥5 CV of the same buffer. The antibody is eluted using an acetate buffer with suitable NaCl concentration (>50 mM; <500 mM), and the eluate is collected by UV-control in typically ≤10 CV collected eluate volume. The column is regenerated using 0.5-2 M NaCl in acetate buffer, re-equilibrated (≥5 CV with CEX equilibration buffer), sanitized (0.5-1.0 M NaOH for ≥30 min), re-equilibrated (≥5 CV with CEX equilibration buffer), and finally stored in e.g. 20% EtOH or 2% BnOH.

Additional Polishing

When additional polishing is needed to remove residual product- or process-related impurities, a mixed mode chromatography (MMC) may be used in place of, or together with, the CEX step. Example of mixed mode chromatographic resins are Capto adhere and Capto MMC ImpRes. This unit operation is typically operated in a flow-through mode but bind-and-elute mode may also be employed. The column can be self- or pre-packed with a bed height of 5-20 cm at various diameters and operated at flow rates between 100-500 cm/h in a flowthrough mode or 100-220 cm/hr in a bind-and-elute mode.

The load is typically adjusted, if needed, to target conductivities between 3-12 mS/cm and to pH 4.2-7.5 with HOAc, Tris titrants or WFI. The load is applied at typical densities between 75-300 g/L onto a MMC column equilibrated with ≥5 CV acetate buffer (pH and conductivity matched to MMC load). A chase with equilibration buffer may be performed and combined with the collected flow-through, the collection criteria of which is controlled by e.g. UV or volume. The MMC column might be used once or multiple times depending on the amount of antibody to be polished. The column is regenerated using 0.5-2 M NaCl in acetate buffer, re-equilibrated (≥5 CV with equilibration buffer), sanitized (0.5-1.0 M NaOH for ≥30 min), and finally stored in e.g. 20% EtOH or 2% BnOH.

Nanofiltration

Potentially remaining adventitious viruses are removed by PDVF-based nanofiltration, e.g. using Planova BioEX with or without prefilter. The load is applied at constant pressure (e.g. 2.0-3.4 bar) with a loading density of 1500-5000 g antibody/m$^2$ to a pre-equilibrated nanofilter (≥5 L/m$^2$ acetate buffer, recipe e.g. matched to MA AEX or CEX elution conditions). The filter may be chased using the same buffer and the integrity of the filter is typically tested post-use. Upon failure of the integrity test, this step may be repeated. Alternatively, adventitious viruses can be removed by cellulose-base nanofiltration with or without a prefilter. The load is applied at a constant pressure (e.g. 0.8-1.2 bar) with a loading density of 500-2000 g antibody/m$^2$ to a pre-equilibrated nanofilter (≥5 L/m$^2$ acetate buffer, recipe e.g. matched to MA AEX or CEX elution conditions).

Concentration and Buffer Exchange

The intermediate is concentrated by ultrafiltration to 15-110 g/L, diafiltered with ≥6 diafilter volumes against a diafiltration buffer (DFB) (e.g. 10 mM histidine, 10 mM methionine, 30 mM arginine, pH 5.3), and, if needed, further concentrated up to 200 g/L. This is typically performed using a tangential-flow filtration device and a suitable membrane with a cutoff of 30-50 kDa (e.g. Millipore Pellicon, Sartorius Hydrosart, Pall Omega) with a load of typically 300-1000 g antibody/m$^2$. The process is typically controlled by feed or retentate flow (e.g. 2-7 L/min/m$^2$), alternatively by feed pressure (2-4 bar), and by TMP (0.7-2 bar). The membrane may be chased by DFB and the pooled retentate diluted with DFB to the target concentration. The TFF system and membranes are sanitized with 0.5 M NaOH and equilibrated with acetate buffer or DFB. The membrane integrity or permeability is tested pre-use.

Stabilization

In an optional stabilization step, an excipient concentrate is added to produce bulk drug substance (BDS). A bioburden reduction filtration (e.g. 0.2 μm) is performed using an e.g. pre-equilibrated filter (e.g. excipient concentrate diluted in DFB), which is tested post-use for integrity. Upon failure of the integrity test, the filtration step may be repeated.

Fill & Freeze

The BDS is filled in suitable bags with an LDPE contact layer (e.g. 5 or 10 L) with individual i.d. sampling compartments that are preferably aseptically connected and disconnected. The bags are individually protective packaged by optional vacu-sealing (LDPE overwrap bags) and placed in protective shells (e.g. RoSS Shells). After an optional intermediate 2-8° C. storage, the shelled bags are frozen (using a plate- or a passive freezer) and subsequently stored at ≤−30 or ≤−60° C., e.g. +/−5° C., alternatively at ≤−25 or ≤−60° C., e.g. +/−5° C.

Aspect 28—Kit of Parts with Antibody Defined by Antigen

According to a 28th aspect, there is provided a kit comprising the antibody or antigen-binding fragment according to the 6$^{th}$, 7$^{th}$, 8$^{th}$, 9$^{th}$, 10$^{th}$, 11$^{th}$, 12$^{th}$, 13$^{th}$, 14$^{th}$, 15$^{th}$, 16$^{th}$, 17$^{th}$ and/or 18$^{th}$ aspect, or a conjugate according to the 19$^{th}$ aspect, or the pharmaceutical composition according to the 20$^{th}$ aspect, with instructions for use.

The antibodies, fragments, conjugates or pharmaceutical compositions of the present invention can be provided in a kit, i.e., a packaged combination of reagents in predetermined amounts in one or more containers with instructions. For example, where the antibody, fragment or conjugate is a therapeutic antibody, fragment or conjugate, the instructions for use may comprise the package insert. For example, the package insert may comprise information describing an advantageous administration mode or combination treatment as described herein.

For example, where the antibody is labeled with an enzyme, the kit may include substrates and cofactors required by the enzyme (e.g., a substrate precursor which provides the detectable chromophore or fluorophore). In addition, other additives may be included such as stabilizers, buffers (e.g., a block buffer or lysis buffer) and the like. The relative amounts of the various reagents may be varied widely to provide for concentrations in solution of the reagents which substantially optimize the sensitivity of the assay. Particularly, the reagents may be provided as dry powders, usually lyophilized, including excipients which on dissolution will provide a reagent solution having the appropriate concentration.

Aspect 29—Combination Treatment Comprising Anti-Ccr8 Antibody

According to one aspect there is provided an anti-CCR8 antibody and a further therapeutically active compound or therapy for use in the treatment of a tumor, wherein the further therapeutically active compound is
a) a chemotherapeutic agent, preferably a taxane, doxorubicin, cis-platin, carboplatin, oxaliplatin, or gemcitabine,
b) an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
c) an antibody targeting a protein which is specifically expressed by the tumor cells,
d) an antibody or a small molecule targeting HER2 and/or EGFR,
e) the standard of care for any of head and neck cancer, breast cancer, gastric cancer, lung cancer, squamous cell carcinoma, esophageal tumor, melanoma, bladder cancer, liver cancer, and/or prostate cancer,
f) a targeted kinase inhibitor, such as Sorafinib, Regorafenib, or MEKi-1, and/or
g) radiation therapy.

In other words, there is provided an anti-CCR8 antibody, preferably an anti-CCR8 antibody inducing ADCC and/or ADCP as described elsewhere herein, for use in the treatment of a tumor, wherein the use comprises administration of a further therapeutically active compound or therapy which does not target a checkpoint protein and is selected from
h) a chemotherapeutic agent, preferably a taxane, paclitaxel, doxorubicin, cis-platin, carboplatin, oxaliplatin, or gemcitabine,
i) an antibody targeting a further chemokine receptor, such as CCR1, CCR2, CCR3, CCR4, CCR5, CCR6, CCR7, CCR9, CCR10, CXCR1, CXCR2, CXCR3, CXCR4, CXCR5, CXCR6, CX3CR1 or CXCR1,
j) an antibody targeting a protein which is specifically expressed by the tumor cells,
k) an antibody or a small molecule targeting HER2 and/or EGFR,
l) the standard of care for any of head and neck cancer, breast cancer, gastric cancer, lung cancer, squamous cell carcinoma, esophageal tumor, melanoma, bladder cancer, liver cancer, and/or prostate cancer,
m) a targeted kinase inhibitor, such as Sorafinib, Regorafenib, or MEKi-1,
n) radiation therapy, and/or
o) (a compound or antibody for) depletion of intra-tumoral B cells, preferably CD19+ B cells.

The anti-CCR8 antibody may be an inventive anti-CCR8 antibody as described herein or any further therapeutically suitable anti-CCR8 antibody known in the art. The tumor may be any tumor described herein, e.g. for the $22^{nd}$ aspect. Preferably, the tumor or disease is characterized by chemokine receptor positive cells, such as CCR8 positive cells, such as CCR8 positive regulatory T cells or CCR8 positive tumor cells. Preferably the tumor is an ICI responsive tumor. Based on the examples described herein (e.g. examples 12.6 ff., see responding mouse models), it is plausible, that in particular those tumors which are or were initially responsive to immune checkpoint inhibition will profit from anti-CCR8 antibody treatment both, alone and in combination. The further therapeutically active compound may be a therapeutically active compound as described elsewhere herein. Suitable taxanes may be selected e.g. from paclitaxel, abraxane, cabazitaxel, or docetaxel, or derivatives thereof. According to a preferred embodiment, the use comprises furthermore administration of a checkpoint inhibitor such as an anti-PD-1 antibody, an anti-PD-L1 antibody or a CTLA4 antibody, e.g. as described elsewhere herein.

Aspect 30—Triple Combination Treatment Comprising Anti-CCR8 Antibody

According to one aspect there is provided an anti-CCR8 antibody, a checkpoint inhibitor such as an anti-PD-1 antibody, an anti-PD-L1 antibody or a CTLA4 antibody, and a further therapeutically active compound or therapy for use in the treatment of a tumor, wherein the further therapeutically active compound or therapy is preferably
a) an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
b) an antibody targeting a protein which is specifically expressed by the tumor cells,
c) an antibody or a small molecule targeting HER2 and/or EGFR,
d) the standard of care for any of head and neck cancer, breast cancer, gastric cancer, lung cancer, squamous cell carcinoma, esophageal tumor, melanoma, bladder cancer, liver cancer, and/or prostate cancer,
e) a chemotherapeutic agent, preferably a taxane, paclitaxel, doxorubicin, cis-platin, carboplatin, oxaliplatin, or gemcitabine,
f) a targeted kinase inhibitor, such as Sorafinib, Regorafenib, or MEKi-1, and/or
g) radiation therapy,
h) (a compound or antibody for) depletion of intra-tumoral B cells, preferably CD19+ B cells.

In other words, there is provided an anti-CCR8 antibody inducing ADCC and/or ADCP for use in the treatment of a tumor, wherein the use comprises administration of a further therapeutically active compound or therapy which does not target a checkpoint protein and is selected from
a) a chemotherapeutic agent, preferably a taxane, paclitaxel, doxorubicin, cis-platin, carboplatin, oxaliplatin, or gemcitabine,
b) an antibody targeting a further chemokine receptor, such as CCR1, CCR2, CCR3, CCR4, CCR5, CCR6, CCR7, CCR9, CCR10, CXCR1, CXCR2, CXCR3, CXCR4, CXCR5, CXCR6, CX3CR1 or CXCR1,
c) an antibody targeting a protein which is specifically expressed by the tumor cells,
d) an antibody or a small molecule targeting HER2 and/or EGFR,
e) a targeted kinase inhibitor, such as Sorafinib, Regorafenib, or MEKi-1,
f) radiation therapy, and/or
depletion of intra-tumoral B cells, preferably CD19+ B cells, and the use comprises furthermore administration of a checkpoint inhibitor such as an anti-PD-1 antibody, an anti-PD-L1 antibody or a CTLA4 antibody, e.g. as described elsewhere herein.

Aspect 31—Sequential Combination Treatment Comprising Anti-CCR8 Antibody

According to one aspect there is provided an anti-CCR8 antibody and a further therapeutically active compound or therapy for use in the treatment of a tumor, wherein a dose of the further therapeutically active compound or therapy is administered after the first dose of the anti-CCR8 antibody, e.g.
a) after the anti-CCR8 antibody has effected an increase of the intratumoral CD8 cell to T reg cell ratio at least by a factor of 2, 3, 4 or 5 or
b) after the anti-CCR8 antibody has depleted at least 40, 45, 50, 55, 60, 65 or 70% of the intratumoral Treg cells.

In other words, there is provided an anti-CCR8 antibody, preferably an anti-CCR8 antibody inducing ADCC and/or ADCP as described elsewhere herein, for use in the treatment of a tumor, wherein the use comprises administration of a further therapeutically active compound or therapy, wherein a dose of the further therapeutically active compound or therapy is administered after the first dose of the anti-CCR8 antibody, preferably
a) after the anti-CCR8 antibody has induced an increase of the intra-tumoral CD8 cell to T reg cell ratio at least by a factor of 2, 3, 4 or 5 or
b) after the anti-CCR8 antibody has depleted at least 40, 45, 50, 55, 60, 65 or 70% of the intra-tumoral Treg cells.

According to a preferred treatment scheme, treatment starts with administration of the first dose of anti-CCR8 antibody (e.g. daily, weekly, q2w, q3w or q4w as described above), followed by administration of the further therapeutically active compound or therapy. Without being bound by theory, the time between the initial dose of anti-CCR8 antibody and the further therapeutically active compound should be chosen to allow for an intra-tumoral Treg depletion of at least 40, 50, or 60%. The anti-CCR8 antibody may be an inventive anti-CCR8 antibody as described herein but may also be any further therapeutically suitable anti-CCR8 antibody. The tumor may be any tumor described herein, e.g. for the $22^{nd}$ aspect. Preferably, the tumor or disease is characterized by chemokine receptor positive cells, such as CCR8 positive cells, such as CCR8 positive regulatory T cells or CCR8 positive tumor cells. Preferably the tumor is or was initially an ICI responsive tumor. Since acquired resistance to PD(L)-1 antibodies might strongly be influenced by intra-tumoral activated regulatory T cells (characterized by CCR8 expression) sequential treatment with an anti-CCR8-antibody combined with a checkpoint inhibitor is beneficial to overcome such an acquired resistance. Administering the further therapeutically active compound or therapy after the first dose of the anti-CCR8 antibody was found to substantially improve the efficacy of the treatment, even for extremely challenging tumor models. The time between the first dose of the anti-CCR8 antibody and the dose of the further therapeutically active compound shall be sufficient to induce a first anti-tumor immune response. According to the data provided herein (cf. examples 12.6 ff), this is indicated by an increase of the intra-tumoral CD8 cell to T reg cell ratio at least by a factor of 2, 3, 4 or 5 or by (temporary) depletion of at least 40, 45, 50, 55, 60, 65 or 70% of the intra-tumoral Treg cells.

The further therapeutically active compound or therapy may be any compound or therapy disclosed elsewhere herein. The therapeutically active compound may or may not be a checkpoint inhibitor, e.g. an anti-PD-L1 antibody, an anti-PD1 antibody or an anti-CTLA4-antibody. Although the second therapeutic agent may be a non-targeted therapeutic, it was found that targeted therapeutics are highly preferred for this purpose. Targeted therapeutics as defined herein are therapeutically active compounds that specifically recognize tumor cells rather than all fast dividing cells or immune cell populations. Although agents targeting all dividing cells or affecting immune cell populations may be used in combination and could improve efficacy (cf. example 12.6.8, 12.6.9), they may interfere with immune cell populations that were required for a sustainable immunological tumor response. This problem was solved by use of an antibody targeting a protein which is specifically expressed by the tumor cells. Preferred targeted therapeutics are antibodies binding a protein which is specifically expressed by the tumor cells.

Preferably, the further therapeutically active compound or therapy is selected from
a) an antibody or a small molecule targeting a checkpoint protein, such as PD-(L)1 or CTLA-4,
b) a chemotherapeutic agent, preferably a taxane, paclitaxel, doxorubicin, cis-platin, carboplatin, oxaliplatin, or gemcitabine,
c) an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
d) an antibody targeting a protein which is specifically expressed by the tumor cells,
e) an antibody or a small molecule targeting HER2 and/or EGFR,
f) a targeted kinase inhibitor, such as Sorafinib, Regorafenib, or MEKi-1,
g) the standard of care for any of head and neck cancer, breast cancer, gastric cancer, lung cancer, squamous cell carcinoma, esophageal tumor, melanoma, bladder cancer, liver cancer, and/or prostate cancer,
h) radiation therapy, and/or
i) (a compound or antibody for) depletion of intra-tumoral B cells, preferably CD19+ B cells.

Suitable taxanes may be selected e.g. from paclitaxel, abraxane, cabazitaxel, or docetaxel, or derivatives thereof.

Preferably, the dose of the further therapeutically active compound or therapy is the first dose of the mentioned further therapeutically active compound or therapy.

Aspect 32—Stratification Methods/Diagnostic Methods

As discussed elsewhere herein, the stratification steps described for the fourth embodiments according to the 22nd aspect may be used either as part of a method of treatment according to the $22^{nd}$ aspect, or are provided stand-alone as a) a method to select subjects that will most likely profit from treatment with an anti-CCR8 antibody,
b) a diagnostic method for diagnosing a tumor as sensitive for treatment with an anti-CCR8 antibody, or
c) a method to monitor the treatment success for treatment with an anti-CCR8 antibody.

For the current aspect the antibody may be an antibody according to the current invention but may also be any therapeutically suitable anti-CCR8 antibody.

Biomarker for Anti-CCR8 Antibody Treatment

So far, no biomarkers are available to predict or monitor the treatment success for anti-CCR8 antibodies. While the demonstrated mode of action suggests that CCR8 itself may serve as a possible biomarker, the inventors found that CCR8 levels are somewhat difficult to assess in a clinical setup or within clinical studies. To solve this pressing problem, the inventors generated hypothesis and could validate some of these as suitable biomarkers with excellent predictive power, see e.g. example 12.7.1 and 12.7.2. The level of marker expression is usually determined with an assay or a method known in the art and the level is subsequently compared with a reference value as described elsewhere herein and is subsequently used to predict or monitor the treatment response.

Provided is a biomarker for use in a method for diagnosing/stratifying a subject as having a tumor that is sensitive for treatment with an anti-CCR8 antibody, the use comprising
a. determining the level of the biomarker in a tumor or tumor sample comprising regulatory T cells,
b. comparing the level of the biomarker with a reference sample or value, and
c. diagnosing/stratifying a subject as having a tumor that is sensitive for treatment with an anti-CCR8 antibody, if the level of the biomarker is higher than or equal to a reference sample or value,
wherein the biomarker is
d. an immune checkpoint protein, preferably PD-1, PD-L1 or CTLA4,
e. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof,
f. a Treg infiltration marker, preferably CCR8, FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7 or CXCL9,
g. a T cell marker or cytotoxic T cell marker preferably selected from CD3, CD4, CD8, CD25, CXCR3, CCR5, 4-1BB, OX-40, or GITR,
h. an interferon or interferon-inducible protein preferably selected from IFN gamma, IL10, IL12p70, IL1beta, IL2 and TNF alpha,
i. a complement factor,
j. a serpin, and/or
k. a molecule derived from a gene according to Table 12.7.2.1, 12.7.2.2 or 12.7.2.3.

Preferably, the biomarker is an immune checkpoint protein, most preferably PD-1, PD-L1 or CTLA4. Also provided is the use of a biomarker to predict or monitor the therapeutic success of a therapy comprising the administration of an anti-CCR8 antibody, the use comprising
a. determining the level of the biomarker in a sample, and
b. comparing the level of the biomarker with a reference sample or value, wherein the biomarker is
c. an immune checkpoint protein, preferably PD-1, PD-L1 or CTLA4,
d. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof
e. a Treg infiltration marker, preferably selected from FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7, CXCL9,
f. a T cell marker or cytotoxic T cell marker, preferably selected from CD3, CD4, CD8, CD25, CXCR3, CCR5, and TNF receptor super family members such as 4-1BB, OX-40, or GITR,
g. an interferon-inducible protein, preferably selected from IFN gamma, IL10, IL12p70, IL1beta, IL2 and TNF alpha,
h. a complement factor,
i. a serpin and/or
j. a molecule derived from a gene according to Table 12.7.2.1, 12.7.2.2 or 12.7.2.3.

Preferably, the biomarker is an immune checkpoint protein, most preferably PD-1, PD-L1 or CTLA4.

Furthermore, there is also provided a molecule binding a biomarker for use in a method for diagnosing/stratifying a subject as having a tumor that is sensitive for treatment with an anti-CCR8 antibody, the use comprising determining the level of the biomarker in a tumor or tumor sample using the molecule binding the biomarker, wherein the biomarker is (preferably)
a. an immune checkpoint protein, preferably PD-1, PD-L1 or CTLA4,
b. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof
c. a Treg infiltration marker, preferably CCR8, FOXP3, ICOS, CCR4, TIGIT, P2RY10, CD80, TNFRSF9, CD3 (G), SLAMF1, IL7R, IL2RB, CTLA4, CD5, ITK, IL2RA, LAX1, IKZF3, GBP5, CXCR6, SIRPG, CD2, CSF2RB, SLAMF7 or CXCL9,
d. a T cell marker or cytotoxic T cell marker preferably selected from CD3, CD4, CD8, CD25, CXCR3, CCR5, 4-1BB, OX-40, or GITR,
e. an interferon or interferon-inducible protein preferably selected from IFN gamma, IL10, IL12p70, IL1beta, IL2 and TNF alpha,
f. a complement factor,
g. a serpin, and/or
h. a molecule derived from a gene according to Table 12.7.2.1, 12.7.2.2 or 12.7.2.3.

The molecule binding the biomarker is preferably an antibody or antigen-binding fragment, or a conjugate thereof. Most preferably, the molecule binding the biomarker is an anti-PD-1, PD-L1 or CTLA4 antibody such as Nivolumab, Pembrolizumab, Atezolizumab, Avelumab, Durvalumab, Cemiplimab, Dostarlimab or Ipilimumab.

Furthermore, there is also provided the use of a molecule binding a biomarker to predict or monitor the therapeutic success of a therapy comprising the administration of an anti-CCR8 antibody, the use comprising determining the level of the biomarker in a tumor or tumor sample using the molecule binding the biomarker, wherein the biomarker is (preferably)

a. an immune checkpoint protein, preferably PD-1, PD-L1 or CTLA4,
b. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof,
c. a Treg infiltration marker, preferably CCR8, FOXP3, ICOS, CCR4, TIGIT, P2RY10, CD80, TNFRSF9, CD3 (G), SLAMF1, IL7R, IL2RB, CTLA4, CD5, ITK, IL2RA, LAX1, IKZF3, GBP5, CXCR6, SIRPG, CD2, CSF2RB, SLAMF7 or CXCL9,
d. a T cell marker or cytotoxic T cell marker preferably selected from CD3, CD4, CD8, CD25, CXCR3, CCR5, 4-1BB, OX-40, or GITR,
e. an interferon or interferon-inducible protein preferably selected from IFN gamma, IL10, IL12p70, IL1beta, IL2 and TNF alpha,
f. a complement factor,
g. a serpin, and/or
h. a molecule derived from a gene according to Table 12.7.2.1, 12.7.2.2 or 12.7.2.3, and
wherein the molecule binding the biomarker is preferably an antibody or antigen-binding fragment, or a conjugate thereof. Most preferably, the molecule binding the biomarker is an anti-checkpoint, anti-PD-1, anti-PD-L1 or anti-CTLA4 antibody such as Nivolumab, Pembrolizumab, Atezolizumab, Avelumab, Durvalumab, Cemiplimab, Dostarlimab or Ipilimumab.

In preferred embodiments of the current aspect, the biomarker is an immune cell marker, and the molecule binding a biomarker is preferably an antibody binding a marker for lymphocytes, effector cells, T cells, cytotoxic T cells, macrophage cells, M1 macrophage cells, M2 macrophage cells, B cells, NK cells, or a combination thereof.

In preferred embodiments of the current aspect, the molecule binding the biomarker is a molecule binding a Treg infiltration marker, preferably an antibody binding CCR8, FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7 or CXCL9.

In preferred embodiments of the current aspect, the molecule binding the biomarker is an antibody binding a T cell marker preferably selected from CD3, CD4, CD8, CD25, CXCR3, CCR5, and TNF receptor super family members including 4-1BB, OX-40, or GITR.

In preferred embodiments of the current aspect, the molecule binding the biomarker is an antibody binding an interferon or interferon-inducible protein preferably selected from INF gamma, IL10, IL12p70, IL1beta, IL2 and TNF alpha.

Immune Checkpoint Protein as Biomarker for Anti-CCR8 Antibody Treatment

According to the current invention it was surprisingly found that the response to (mono) therapy with anti-CCR8 antibody was improved for subjects that were at least initially responsive to ICI treatment, and in particular to anti-PD-(L)1 or CTLA4 antibody treatment, see e.g. Table 12.7.1. Because PD-L1 expression is a predictor for responsiveness to anti-PD-L1 antibody treatment, the inventors hypothesized that PD-L1 expression and checkpoint protein expression per se might also be suitable to directly predict the response to anti-CCR8 antibody treatment. This hypothesis could be confirmed by correlation data between PD-L1 expression and anti-CCR8 antibody treatment response (Table 12.8.1). PD-L1 expression can be determined as known in the art, e.g. without limitation by using Tumor Proportion Score (TPS), Combined Positive Score (CPS), or mRNA expression. The inventors therefore suggest immune checkpoint marker and particularly PD-L1 as surrogate marker for stratification to overcome the problem that CCR8 is difficult to analyze and is therefore difficult to implement in order to select patient populations that could most likely benefit from anti-CCR8 antibody treatment.

Accordingly, there is provided a molecule binding an immune checkpoint protein for use in a method for diagnosing/stratifying a subject as having a tumor that is sensitive for treatment with an anti-CCR8 antibody, the method comprising
a. determining the level of the immune checkpoint protein expression in a tumor (sample),
b. comparing the level of immune checkpoint protein expression with a reference sample or value, and
c. diagnosing/stratifying a subject as having a tumor that is sensitive for treatment with an anti-CCR8 antibody, if the level of immune checkpoint protein expression is higher than or equal to a reference sample or value.

Furthermore, there is provided the use of a molecule binding an immune checkpoint protein for monitoring treatment success of anti-CCR8 antibody therapy, the method comprising
a. determining the level of the immune checkpoint protein expression in a tumor (sample)/a sample, and
b. comparing the level of immune checkpoint protein expression with a reference sample or value.

The molecule binding an immune checkpoint protein is preferably an antibody. The immune checkpoint protein is preferably PD-1, PD-L1 or CTLA4. The molecule binding an immune checkpoint protein is preferably an antibody binding PD-1, PD-L1 or CTLA4. For example, the antibody can be PD-L1 28-8, PD-L1 22C3, PD-L1 SP142, PD-L1 SP263 or any other suitable antibody known in the art as companion diagnostic. In particularly preferred embodiments, the level of checkpoint protein expression is determined based on Combined Positive Score (CPS) or Tumor Proportion Score (TPS). A subject or patients tumor is diagnosed/stratified as sensitive for treatment with an anti-CCR8 antibody, if immune checkpoint protein expression is present or high, e.g. as indicated by a CPS≥1, preferably by a CPS≥5, most preferably by a CPS≥10, or as indicated by a TPS≥1%, preferably by a TPS≥10%, most preferably by a TPS≥50%. Thus, in some preferred embodiments, the reference value is CPS=1, more preferably CPS=5 or most preferably CPS=10. In some other or the same preferred embodiments, the reference value is TPS=1%, more preferably TPS=10%, or most preferably TPS≥50%.

In some preferred embodiments, PD-L1 expression is determined by a CPS≥1, preferably by a CPS≥5, most preferably by a CPS≥10 or is determined by a TPS≥1%, preferably by a TPS≥10%, most preferably by a TPS≥50%.

Treg Infiltration Marker as Biomarker for Anti-CCR8 Antibody Treatment

There is provided a molecule binding a Treg infiltration marker for use in a method for diagnosing/stratifying a subject as having a tumor that is sensitive for treatment with an anti-CCR8 antibody, the method comprising
a. determining the level of the Treg infiltration marker expression in a tumor (sample),
b. comparing the level of the Treg infiltration marker expression with a reference sample or value, and c. diagnosing/stratifying a subject as having a tumor that is sensitive for treatment with an anti-CCR8 antibody, if the level of the Treg infiltration marker is higher than or equal to a reference sample or value.

The Treg infiltration marker is a marker that is highly expressed on activated Tregs. Preferably, the Treg infiltration marker is selected from CCR8, FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7, CXCL9, cf. Table 11.1.1, Table 12.8.1. The Treg infiltration marker can be different from CCR8. The molecule binding a Treg infiltration marker is preferably an antibody, e.g. an antibody binding to one or more of the Treg infiltration markers.

The Treg infiltration marker disclosed herein may also be used as biomarker to control the treatment success, e.g. as described elsewhere herein. A treatment is considered successful, if a (temporary) Treg depletion of at least 40% or 50% is obtained, as indicated e.g. by a decrease of the Treg infiltration marker by a factor of 2.

Immune Cell Marker as Biomarker for Anti-CCR8 Antibody Treatment

There is provided a molecule binding an immune cell marker for use in a method for diagnosing/stratifying a subject as having a tumor that is sensitive for treatment with an anti-CCR8 antibody, the method comprising
a. determining the level of the immune cell marker expression in a tumor (sample),
b. comparing the level of the immune cell marker expression with a reference sample or value, and
c. diagnosing/stratifying a subject as having a tumor that is sensitive for treatment with an anti-CCR8 antibody, if the level of the immune cell marker is higher than or equal to a reference sample or value.

The immune cell marker may be a marker for lymphocytes, effector cells, T cells, cytotoxic T cells, macrophage cells, M1 macrophage cells, M2 macrophage cells, B cells, NK cells, or a combination thereof. Suitable markers for these immune cell populations are described throughout this disclosure. For example, suitable T cell markers include CD3 (e.g. CD3E, D and/or G). For example, suitable cytotoxic T cell markers include CD8 (e.g. CD8A and/or B). For example, suitable macrophage cell markers include MS4A7. For example, suitable macrophage M1 cell markers include Acod1. For example, suitable M2 macrophage cell markers include Mrc1. For example, suitable B cell markers include CD19, CD20, CD22 and/or MSA41.

The immune cell marker disclosed herein may also be used as biomarker to control the treatment success, e.g. as described elsewhere herein. A treatment is considered successful, if a (temporary) immune cell increase occurs, e.g. of at least 50%, e.g. as indicated by an increase of the immune cell infiltration marker by a factor of at least 2.

T Cell Marker as Biomarker for Anti-CCR8 Antibody Treatment

There is provided a molecule binding a T cell marker for use in a method for diagnosing/stratifying a subject as having a tumor that is sensitive for treatment with an anti-CCR8 antibody, the method comprising
a. determining the level of the T cell marker expression in a tumor (sample),
b. comparing the level of the T cell marker expression with a reference sample or value, and
c. diagnosing/stratifying a subject as having a tumor that is sensitive for treatment with an anti-CCR8 antibody, if the level of the T cell marker is higher than or equal to a reference sample or value.

The T cell marker may be a marker that is highly expressed on T cells, such as activated T cells. Preferably, the T cell marker is selected from CD3, CD4, CD8, CD25, CXCR3, CCR5, and TNF receptor super family members including 4-1BB, OX-40, or GITR. The molecule binding the T cell marker is preferably an antibody, e.g. an antibody binding to one or more of the T cell markers disclosed herein.

The T cell marker disclosed herein may also be used as biomarker to control the treatment success, alone or in combination with a Treg infiltration marker, e.g. as described elsewhere herein. A treatment is considered successful, if a (temporary) T cell increase occurs, e.g. of at least 50%, e.g. as indicated by an increase of the T cell marker by a factor of at least 2.

Interferon or Interferon-Inducible Protein as Biomarker for Anti-CCR8 Antibody Treatment There is provided an interferon or interferon-inducible protein for use in a method for diagnosing/stratifying a subject as having a tumor that is sensitive for treatment with an anti-CCR8 antibody or for monitoring treatment success, the method comprising
a. determining the level of interferon or interferon-inducible protein in a tumor (sample),
b. comparing the level of the interferon or interferon-inducible protein with a reference sample or value, and
c. diagnosing/stratifying a subject as having a tumor that is sensitive for treatment with an anti-CCR8 antibody, if the level interferon or interferon-inducible protein is higher than or equal to a reference sample or value.

The interferon or interferon-inducible proteins is preferably selected from IFN gamma, IL10, IL12p70, IL1beta, IL2 and TNF alpha. According to the current invention it was found that the correlation of CCR8 mRNA expression with inflammation marker IFN gamma was significant for 50 tumor indications, cf. Table 11.1.2. From this it can be concluded that IFN gamma levels may be suitable as biomarkers as disclosed herein. This was confirmed e.g. in example 12.6.2, where IFN gamma and also TNF alpha levels correlated with treatment response. In a different experiment (example 12.6.6), increased levels of IFN gamma, IL-1b and IL-2 were associated with improved efficacy. Suitable interferon-stimulated genes or proteins include without limitation ACOD1, ACTG1, ACTR2, ACTR3, ADAMTS13, AIF1, AQP4, ASS1, B2M, BST2, C9JQL5, CALCOCO2, CAMK2A, CAMK2B, CAMK2D, CAMK2G, CASP1, CCL1, CCL11, CCL13, CCL14, CCL15, CCL15, CCL14, CCL16, CCL17, CCL18, CCL19, CCL2, CCL20, CCL21, CCL22, CCL23, CCL24, CCL25, CCL26, CCL3, CCL3L1, CCL4, CCL4L1, CCLS, CCL7, CCL8, CD40, CD44, CD58, CDCl42EP2, CDCl42EP4, CIITA, CITED1, CLDN1, CX3CL1, CXCL16, CYP27B1 DAPK1, DAPK3, EDN1, EPRS, EVL, FCGR1A, FCGR1B, FLNB, GAPDH, GBP1, GBP2, GBP4, GBP5, GBP6, GCH1, GSN, HCK, HLA-A, HLA-B, HLA-C, HLA-DPA1, HLA-DPB1, HLA-DQA1, HLA-DQA2, HLA-DQB1, HLA-DQB2, HLA-DRA HLA-DRB1, HLA-DRB3, HLA-DRB4, HLA-DRB5, HLA-E, HLA-F, HLA-G, HLA-H, ICAM1, IFI30, IFITM1, IFITM2, IFITM3, IFNG, IFNGR1, IFNGR2, IL12B, IL12RB1 IL23R, IRF1, IRF2, IRF3, IRF4, IRF5, IRF6, IRF7, IRF8, IRF9, JAK1, JAK2, KIF16B, KIF5B, KYNU, LGALS9, MEFV, MID1, MRC1, MT2A, MYO1C, NCAM1, NMI, NOS2, NUB1, OAS1, OAS2, OAS3, OASL, PDE12, PML, PRKCD, PTAFR, RAB12, RAB20, RAB43, RAB7B, RPL13A, RPS6KB1 RYDEN, SEC61A1 SLC11A1 SLC26A6 SLC30A8 SNCA, SP100, STAR, STAT1, STX4, STX8, STXBP1, STXBP2, STXBP3, STXBP4, SYNCRIP TDGF1, TLR2, TLR3, TLR4, TRIM21, TRIM22, TRIM25, TRIM26, TRIM31, TRIM34, TRIM38, TRIMS, TRIM62, TRIM68, TRIMS, UBD, VAMP3, VCAM1, VIM, VPS26B, WAS, WNT5A, XCL1, XCL2, ZYX.

EXAMPLES

Example 1: Alignment CC Chemokine Receptors & CXC Chemokine Receptors

Human CC and CXC chemokine receptor sequences were retrieved from Uniprot and aligned with Clustal Omega. Results were imported in Jalview for visualization (FIG. 1). Negative amino acid residues E and D (grey), as well as tyrosine residues (Y, dark grey) and cysteine residues (C, light grey) are highlighted. While the N terminal domains deviate in sequence, they are characterized by a comparably high number of negatively charged amino acids and tyrosine residues.

Example 2: Alignment of Human, Cynomolgus and Murine CCR8

Human CCR8, cynomolgus CCR8 and murine CCR8 sequences were retrieved from Uniprot and aligned with Clustal Omega. Results were imported in Jalview for visualization and calculation of sequence identity, see FIG. 2A. While pairwise alignment of human and cynomolgus CCR8 yields a sequence identity of 94.37%, percentages are considerably lower between mouse and human CCR8 (Percentage ID=70.99), as well as between mouse and cynomolgus CCR8 (Percentage ID=71.55). Substantial differences can be observed in N term (TRD) region and C term region.

The sequence homology between the cynomolgus TRD and the human TRD is 68%, while sequence homology between the murine TRD and the human TRD is 52%. Nevertheless, the acidic and tyrosine-sulfated TRD shows a negatively charged cluster which was successfully used to generate cross-reactive antibodies, see example 6. At least the MDYT and YYPD motifs were found to be conserved between the species.

Example 3: Evaluation of Prior Art Antibodies for Specific Binding to CCR8

FACS experiments were performed using CCR8 expressing cell lines to evaluate multiple prior art antibodies which are commercially sold as CCR8 binding for their specificity and staining to CCR8. Mouse T lymphoma cell line BW5147.4 expresses murine CCR8 and human cutaneous T lymphoma, HuT78 expresses low levels of human CCR8. Prior art antibodies for chemokine receptors and in particular for CCR8 often suffer from low specificity as described e.g. by Xing et al., Appl IHC Mol Morphol (2015): "We were unable to evaluate CCR8 expression by immunohistochemistry due to lack of specificity of available antibodies in our experience and as previously published by others.", Chenivesse et al., JI (2012): "We were unable to evaluate the attraction of CD4$^+$CCR8$^+$ cells by CCL18 because of the lack of specificity of all commercially available anti-CCR8 Abs, which did not allow cell sorting, at least in our hands.", or Pease, Biochem J (2011): "The latter has been problematic due to the lack of a seemingly reliable antibody against human CCR8. For example, in one study examining CCR8 expression on a population of CD4+CD25+ Tregs, CCR8 surface staining was undetectable using a commercially available antibody, although the cells evidently expressed functional CCR8, as assessed by CCL1-driven actin polymerization." (cf. Xing, Xiaoming, et al. "Expression of the chemokine receptor gene, CCR8, is associated With DUSP22 rearrangements in anaplastic large cell lymphoma." Applied immunohistochemistry & molecular morphology: AIMM/official publication of the Society for Applied Immunohistochemistry 23.8 (2015): 580; Chenivesse, Cecile, et al. "Pulmonary CCL18 recruits human regulatory T cells." The Journal of Immunology 189.1 (2012): 128-137.; and Pease, James E. "Targeting chemokine receptors in allergic disease." Biochemical Journal 434.1 (2011): 11-24.).

Figure 3:
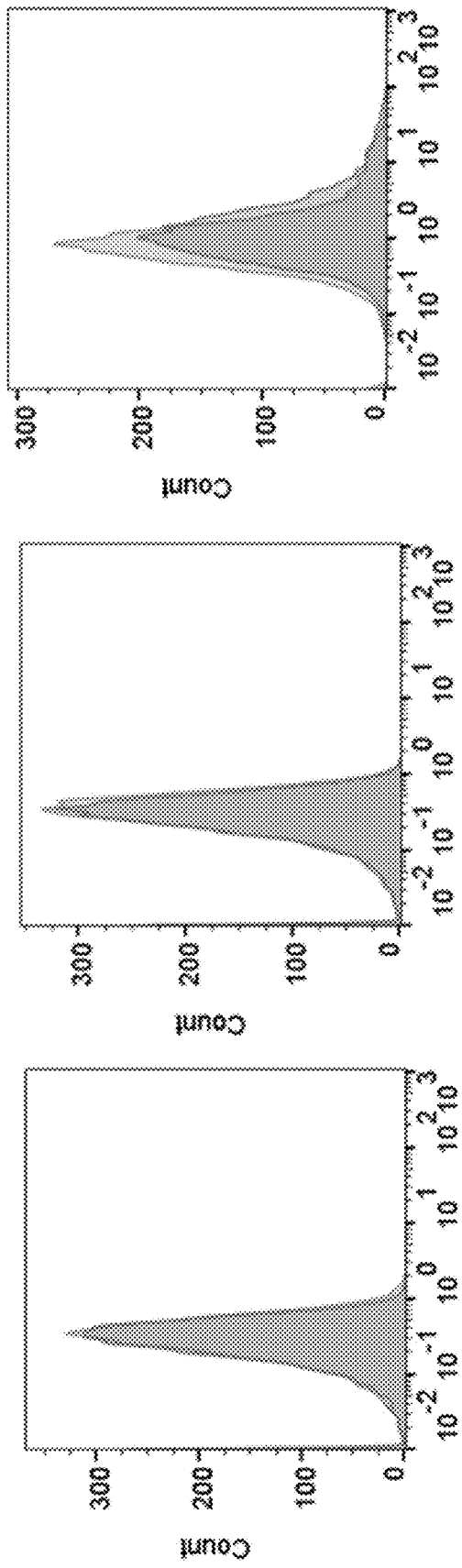
FIG. 3: Evaluation of three prior art antibodies by FACS staining in CCR8 positive target cells. None of the shown prior art antibodies showed a shift in FACS staining compared with the isotype control. hAP-0068 and MAB1429-100 were tested on 293T cells stably transfected with human CCR8 while MAB8324 was tested on BW5147.3 cells expressing murine CCR8.

Table 3.1 lists three analyzed commercially available antibodies, which did not specifically stain CCR8 in the inventors' hands (cf. FIG. 3). Rat IgG2B Clone #191704 (MAB1429, R&D systems) did not show specific binding of human CCR8 and this is also in agreement with the observations described in Example 6 of WO2007044756. Abcam E77 showed very weak signal and high background (data not shown). MM0068-4G19 (Abeam), 191704 (R&D Systems), 4G19 (Biozol (Genetex)) and 11n24 and 10k39 (both anti-koerper-online.de) did not show specific binding of human CCR8 in the inventors' hands.

TABLE 3.1

| | Selected prior art antibodies, cf. FIG. 3. | | |
|---|---|---|---|
| Vendor | Angioproteomie | R&D | R&D |
| Item | Rat anti-human CCR8 [MM0068-4G19] | Monoclonal rat anti-human CCR8 Ab | Recombinan tMonoclonal Rabbit IgG Clone #1055C |
| Catalog Number | hAP-0068 | MAB1429-100 | MAB8324 |
| Immunogen | Human CCR8 transfected 293 cells | BaF3 mouse pro-B cell line transfected with human CCR8 Met1-Leu355 Accession # P51685 | HEK293 human embryonic kidney cell line transfected with mouse CCR8 |

TABLE 3.1-continued

Selected prior art antibodies, cf. FIG. 3.

| Vendor | Angioproteomie | R&D | R&D |
|---|---|---|---|
| Reactivity | Human | Human | mouse |
| Antigen | CCR8 | CCR8 | CCR8 |
| Applications | FACS | neutralize CCL1-induced chemotaxis $ND_{50}$ 0.01-0.05 µg/mL | Stains by FACS mouse CCR8 transfectants but not irrelevant transfectants |
| Host | rat | rat | rabbit |
| Isotype | Rat IgG2 | Rat $IgG_{2B}$ Clone # 191704 | Clone # 1055C |

The inventors found only two reliable monoclonal antibodies in the prior art which specifically bound to human CCR8: Clone 433H developed by ICOS and initially disclosed in WO2007044756 and L263G8 provided and sold by Biolegend. Both antibodies were generated using cells overexpressing human CCR8 as immunogen. L263G8 is not cross reactive for murine CCR8 and did not bind to murine CCR8 in BW5147.3 cells or HEK 293T cells transfected with mCCR8.

Monoclonal Rat IgG2b, κ anti-mouse CCR8 clone SA214G2 (Biolegend Catalog No. 150302) stained positive for murine CCR8 expressing BW5147.4 cells. This antibody was generated based on cells transfected with murine CCR8.

In summary, antibodies specifically recognizing human CC chemokine receptors are rare for some members of this target class. The low rates are in line with results for further commercially available antibodies sold for human chemokine receptors.

Example 4: Antigens for CC and CXC Chemokine Receptors

Because the literature on tyrosine sulfation is incomplete and partially contradictory, e.g. between species, the inventors used various available tools, literature search and own experiences to predict sulfation sites. Table 4.1 summarizes the resulting polypeptides suitable as antigens to obtain improved antibodies for the respective chemokine receptors. These antigens were successfully used for antibody generation, e.g. as shown in the subsequent examples, either as antigens or for off target panning. Underlined sulfation sites were confirmed with an E-cuttoff value of 55 by applying the algorithm according to Monigatti F. et al. (Monigatti, Flavio, et al. "The Sulfinator: predicting tyrosine sulfation sites in protein sequences." Bioinformatics 18.5 (2002): 769-770.). None of the sequences had previously been included in the training set for the hidden markov models.

Sulfation of tyrosines in brackets can be omitted. For human CCR3 and human CCR8, additional sulfation sites were predicted for Y172 and Y353, respectively. For monkey CCR3 and monkey CCR2 additional sulfation sites were predicted for Y172 and Y188, respectively. Sulfation sites shown in bold have been previously described in literature (cf. Liu, Justin, et al. "Tyrosine sulfation is prevalent in human chemokine receptors important in lung disease." American journal of respiratory cell and molecular biology 38.6 (2008): 738-743; Millard; Christopher J., et al. "Structural basis of receptor sulfotyrosine recognition by a CC chemokine: the N-terminal region of CCR3 bound to CCL11/eotaxin-1." Structure 22.11 (2014): 1571-1581).

Peptide Design

The N term for CCR8 is formed by the amino acids 1 to 35 within the human and cynomolgus CCR8 full length protein and by amino acids 1 to 33 for the mouse CCR8 full length protein. The N term consists of the TRD (amino acids 1-24 for human and cynomolgus CCR8 and amino acids 1-22 for mouse CCR8), and the LID domain (amino acids 26-35 for human and cynomolgus CCR8 and amino acids 24-33 for mouse CCR8), which are connected by a cysteine. For the synthesis of polypeptides comprising the N term, the cysteine was replaced by a serine to avoid aggregation of the peptides. Table 5.1 shows the respective IDs of the polypeptides which were used for generation of anti-CCR8 antibodies by phage display panning as described in Example 6. To test if posttranslational modifications of proteins were causing the difficulties for the antibody generation, peptides comprising TRD and/or N term sequences were used, which were either unmodified or sulfated. Sulfation on the cynomolgus and human TRD of CCR8 were introduced on at least 50% of the tyrosines, e.g. on the positions 3, 15 and 17 of the respective peptides. For the mouse TRD and N term peptides, sulfations were introduced on the tyrosines at position 3, 14 and 15 of the respective peptides (cf. Table 6.1). In addition, peptides comprising the LID where engineered by introduction of a C-terminal biotinylation that was attached via a TTDS (Trioxatridecan-succinamic acid) linker. Other tags and linkers can also be used. The peptides for the TRD or N term were modified by introduction of a N-terminal biotinylation attached via a TTDS-Lysin linker. Again, further known linker and/or tags can likewise be used to facilitate immobilization of the peptides.

TABLE 4.1

Polypeptides for antigen or off target panning for generation of chemokine receptor antibodies. At least one sulfation at one of the listed tyrosine positions of the polypeptide is required according to the invention, but sulfations at two three or more sites are also possible and may be beneficial. X can be any amino acid or no amino acid, and preferably, is an amino acid different from cysteine, such as serine.

| SEQ ID NO: | Anti-Species | Domain | Sulfation sites | Sequence | Length | Additional modifications (optional) |
|---|---|---|---|---|---|---|
| 1 | CCR1 HUMAN | TRD | Y10, Y18 | METPNTTEDYDTTTEFDYGDATP | 23 | N-terminal biotinylation (e.g. via TTDS_Lysin linker) |
| 2 | CCR1 MACFA | TRD | Y10, Y18 | METPDTTENYDMITEFDYGDATP | 23 | N-terminal biotinylation (e.g. via TTDS_Lysin linker) |

TABLE 4.1-continued

Polypeptides for antigen or off target panning for generation of chemokine receptor antibodies. At least one sulfation at one of the listed tyrosine positions of the polypeptide is required according to the invention, but sulfations at two three or more sites are also possible and may be beneficial. X can be any amino acid or no amino acid, and preferably, is an amino acid different from cysteine, such as serine.

| SEQ ID NO: | Anti-gen | Species | Domain | Sulfation sites | Sequence | Length | Additional modifications (optional) |
|---|---|---|---|---|---|---|---|
| 3 | CCR1 | MOUSE | TRD | Y10, Y18 | MEISDFTEAYPTTTEFDYGDSTP | 23 | N-terminal biotinylation (e.g. via TTDS_Lysin linker) |
| 4 | CCR1 | HUMAN | N term | Y10, Y18 | METPNTTEDYDTTTEFDYGDATPXQ KVNERAFGA | 34 | N-terminal biotinylation (e.g. via TTDS_Lysin linker); C24S (to avoid aggregation) |
| 5 | CCR1 | MACFA | N term | Y10, Y18 | METPDTTENYDMITEFDYGDATPXH KVNERAILA | 34 | N-terminal biotinylation (e.g. via TTDS_Lysin linker); C24S (to avoid aggregation) |
| 6 | CCR1 | MOUSE | N term | Y10, Y18 | MEISDFTEAYPTTTEFDYGDSTPXQK TAVRAFGA | 34 | N-terminal biotinylation (e.g. via TTDS_Lysin linker); C24S (to avoid aggregation) |
| 7 | CCR2 | HUMAN | TRD | Y26, Y28 | MLSTSRSRFIRNTNESGEEVTTFFDYD YGAP | 31 | N-terminal biotinylation (e.g. via TTDS_Lysin linker) |
| 8 | CCR2 | MACMU | TRD | Y26, Y28 | MLSTSRSRFIRNTNGSGEEVTTFFDYD YGAP | 31 | N-terminal biotinylation (e.g. via TTDS_Lysin linker) |
| 9 | CCR2 | MOUSE | TRD | Y37, Y39 | MEDNNMLPQFIHGILSTSHSLFTRSIQ ELDEGATTPYDYDDGEP | 44 | N-terminal biotinylation (e.g. via TTDS_Lysin linker) |
| 10 | CCR2 | HUMAN | N term | Y26, Y28 | MLSTSRSRFIRNTNESGEEVTTFFDYD YGAPXHKFDVKQIGA | 42 | N-terminal biotinylation (e.g. via TTDS_Lysin linker); C32S (to avoid aggregation) |
| 11 | CCR2 | MACMU | N term | Y26, Y28 | MLSTSRSRFIRNTNGSGEEVTTFFDYD YGAPXHKFDVKQIGA | 42 | N-terminal biotinylation (e.g. via TTDS_Lysin linker); C32S (to avoid aggregation) |
| 12 | CCR2 | MOUSE | N term | Y37, Y39 | MEDNNMLPQFIHGILSTSHSLFTRSIQ ELDEGATTPYDYDDGEPXHKTSVKQI GA | 55 | N-terminal biotinylation (e.g. via TTDS_Lysin linker); C45S (to avoid aggregation) |
| 13 | CCR3 | HUMAN | TRD | Y16, Y17 | MTTSLDTVETFGTTSYYDDVGLL | 23 | N-terminal biotinylation (e.g. via TTDS_Lysin linker) |
| 14 | CCR3 | MACFA | TRD | Y16 | MTTSLDTVETFGPTSYDDDMGLL | 23 | N-terminal biotinylation (e.g. via TTDS_Lysin linker) |
| 15 | CCR3 | MOUSE | TRD | Y20, Y22 | MAFNTDEIKTVVESFETTPYEYEWAP P | 27 | N-terminal biotinylation (e.g. via TTDS_Lysin linker) |
| 16 | CCR3 | HUMAN | N term | Y16, Y17 | MTTSLDTVETFGTTSYYDDVGLLXEK ADTRALMA | 34 | N-terminal biotinylation (e.g. via TTDS_Lysin linker); C24S (to avoid aggregation) |
| 17 | CCR3 | MACFA | N term | Y16 | MTTSLDTVETFGPTSYDDDMGLLXE KADVGALIA | 34 | N-terminal biotinylation (e.g. via TTDS_Lysin linker); C24S (to avoid aggregation) |
| 18 | CCR3 | MOUSE | N term | Y20, Y22 | MAFNTDEIKTVVESFETTPYEYEWAP PXEKVRIKELGS | 38 | N-terminal biotinylation (e.g. via TTDS_Lysin linker); C28S (to avoid aggregation) |
| 19 | CCR4 | HUMAN | TRD | (Y16, Y19, Y20), Y22 | MNPTDIADTTLDESIYSNYYLYESIPK P | 28 | N-terminal biotinylation (e.g. via TTDS_Lysin linker) |
| 20 | CCR4 | MACFA | TRD | (Y16, Y19, Y20), Y22 | MNPTDIADTTLDESIYSNYYLYESIPK P | 28 | N-terminal biotinylation (e.g. via TTDS_Lysin linker) |
| 21 | CCR4 | MOUSE | TRD | (Y16, Y19, Y20), Y22 | MNATEVTDTTQDETVYNSYYFYESM PKP | 28 | N-terminal biotinylation (e.g. via TTDS_Lysin linker) |
| 22 | CCR4 | HUMAN | N term | (Y16, Y19, Y20), Y22 | MNPTDIADTTLDESIYSNYYLYESIPK PXTKEGIKAFGE | 39 | N-terminal biotinylation (e.g. via TTDS_Lysin linker); C29S (to avoid aggregation) |

TABLE 4.1-continued

Polypeptides for antigen or off target panning for generation of chemokine receptor antibodies. At least one sulfation at one of the listed tyrosine positions of the polypeptide is required according to the invention, but sulfations at two three or more sites are also possible and may be beneficial. X can be any amino acid or no amino acid, and preferably, is an amino acid different from cysteine, such as serine.

| SEQ ID NO: | Anti-gen | Species | Domain | Sulfation sites | Sequence | Length | Additional modifications (optional) |
|---|---|---|---|---|---|---|---|
| 23 | CCR4 | MACFA | N term | (Y16, Y19, Y20), Y22 | MNPTDIADTTLDESIYSNYYLYESIPK PXTKEGIKAFGE | 39 | N-terminal biotinylation (e.g. via TTDS_Lysin linker); C29S (to avoid aggregation) |
| 24 | CCR4 | MOUSE | N term | (Y16, Y19, Y20), Y22 | MNATEVTDTTQDETVYNSYYFYESM PKPXTKEGIKAFGE | 39 | N-terminal biotinylation (e.g. via TTDS_Lysin linker); C29S (to avoid aggregation) |
| 25 | CCR5 | HUMAN | TRD | Y3, Y10, Y14, Y15 | MDYQVSSPIYDINYYTSEP | 19 | N-terminal biotinylation (e.g. via TTDS_Lysin linker) |
| 26 | CCR5 | MACFA | TRD | Y3, Y10, Y14, Y15 | MDYQVSSPTYDIDYYTSEP | 19 | N-terminal biotinylation (e.g. via TTDS_Lysin linker) |
| 27 | CCR5 | MOUSE | TRD | Y10, Y12, Y16 | MDFQGSVPTYSYDIDYGMSAP | 21 | N-terminal biotinylation (e.g. via TTDS_Lysin linker) |
| 28 | CCR5 | HUMAN | N term | Y3, Y10, Y14, Y15 | MDYQVSSPIYDINYYTSEPXQKINVK QIAA | 30 | N-terminal biotinylation (e.g. via TTDS_Lysin linker); C20S (to avoid aggregation) |
| 29 | CCR5 | MACFA | N term | Y3, Y10, Y14, Y15 | MDYQVSSPTYDIDYYTSEPXQKINVK QIAA | 30 | N-terminal biotinylation (e.g. via TTDS_Lysin linker); C20S (to avoid aggregation) |
| 30 | CCR5 | MOUSE | N term | Y10, Y12, Y16 | MDFQGSVPTYSYDIDYGMSAPXQKIN VKQIAA | 32 | N-terminal biotinylation (e.g. via TTDS_Lysin linker); C22S (to avoid aggregation) |
| 31 | CCR6 | HUMAN | TRD | Y18, Y26, Y27 | MSGESMNFSDVFDSSEDYFVSVNTSY YSVDSEMLL | 35 | N-terminal biotinylation (e.g. via TTDS_Lysin linker) |
| 32 | CCR6 | MACFA | TRD | Y23, Y31, Y32 | MFLPTMSGESMNFSDVFDSSEDYFAS VNTSYYTVDSEMLL | 40 | N-terminal biotinylation (e.g. via TTDS_Lysin linker) |
| 33 | CCR6 | MOUSE | TRD | (Y7), Y13, Y18, Y19 | MNSTESYFGTDDYDNTEYYSIPPDHG P | 27 | N-terminal biotinylation (e.g. via TTDS_Lysin linker) |
| 34 | CCR6 | HUMAN | N term | Y18, Y26, Y27 | MSGESMNFSDVFDSSEDYFVSVNTSY YSVDSEMLLXSLQEVRQFSRL | 47 | N-terminal biotinylation (e.g. via TTDS_Lysin linker); C36S (to avoid aggregation) |
| 35 | CCR6 | MACFA | N term | Y23, Y31, Y32 | MFLPTMSGESMNFSDVFDSSEDYFAS VNTSYYTVDSEMLLXTLHEVRQFSRL | 52 | N-terminal biotinylation (e.g. via TTDS_Lysin linker); C41S (to avoid aggregation) |
| 36 | CCR6 | MOUSE | N term | (Y7), Y13, Y18, Y19 | MNSTESYFGTDDYDNTEYYSIPPDHG PXSLEEVRNFTKV | 39 | N-terminal biotinylation (e.g. via TTDS_Lysin linker); C28S (to avoid aggregation) |
| 37 | CCR7 | HUMAN | TRD | Y8, Y17 | QDEVTDDYIGDNTTVDYTLFESL | 23 | N-terminal biotinylation (e.g. via TTDS_Lysin linker) |
| 38 | CCR7 | MACFA | TRD | Y8, Y17 | QDEVTDDYIGDNTTVDYTLFESL | 23 | N-terminal biotinylation (e.g. via TTDS_Lysin linker) |
| 39 | CCR7 | MOUSE | TRD | Y8, Y17, Y20 | QDEVTDDYIGENTTVDYTLYESV | 23 | N-terminal biotinylation (e.g. via TTDS_Lysin linker) |
| 40 | CCR7 | HUMAN | N term w/o Signal Peptide | Y8, Y17 | QDEVTDDYIGDNTTVDYTLFESLXSK KDVRNFKAW | 35 | N-terminal biotinylation (e.g. via TTDS_Lysin linker); C24S (to avoid aggregation) |

TABLE 4.1-continued

Polypeptides for antigen or off target panning for generation of chemokine receptor antibodies. At least one sulfation at one of the listed tyrosine positions of the polypeptide is required according to the invention, but sulfations at two three or more sites are also possible and may be beneficial. X can be any amino acid or no amino acid, and preferably, is an amino acid different from cysteine, such as serine.

| SEQ ID NO: | Anti-gen | Species | Domain | Sulfation sites | Sequence | Length | Additional modifications (optional) |
|---|---|---|---|---|---|---|---|
| 41 | CCR7 | MACFA | N term w/o Signal Peptide | Y8, Y17 | QDEVTDDYIGDNTTVDYTLFESLXSKKDVRNFKAW | 35 | N-terminal biotinylation (e.g. via TTDS_Lysin linker); C24S (to avoid aggregation) |
| 42 | CCR7 | MOUSE | N term w/o Signal Peptide | Y8, Y17, Y20 | QDEVTDDYIGENTTVDYTLYESVXFKKDVRNFKAW | 35 | N-terminal biotinylation (e.g. via TTDS_Lysin linker); C24S (to avoid aggregation) |
| 43 | CCR8 | HUMAN | TRD | Y3, Y15, (16), Y17 | MDYTLDLSVTTVTDYYYPDIFSSP | 24 | N-terminal biotinylation (e.g. via TTDS_Lysin linker) |
| 44 | CCR8 | MACFA | TRD | Y3, Y15, (16), Y17 | MDYTLDPSMTTMTDYYYPDSLSSP | 24 | N-terminal biotinylation (e.g. via TTDS_Lysin linker) |
| 45 | CCR8 | MOUSE | TRD | Y3, Y14, Y15 | MDYTMEPNVTMTDYYPDFFTAP | 22 | N-terminal biotinylation (e.g. via TTDS_Lysin linker) |
| 46 | CCR8 | HUMAN | N term | Y3, Y15, (16), Y17 | MDYTLDLSVTTVTDYYYPDIFSSPXDAELIQTNGK | 35 | N-terminal biotinylation (e.g. via TTDS_Lysin linker); C25S (to avoid aggregation) |
| 47 | CCR8 | MACFA | N term | Y3, Y15, (16), Y17 | MDYTLDPSMTTMTDYYYPDSLSSPXDGELIQRNDK | 35 | N-terminal biotinylation (e.g. via TTDS_Lysin linker); C25S (to avoid aggregation) |
| 48 | CCR8 | MOUSE | N term | Y3, Y14, Y15 | MDYTMEPNVTMTDYYPDFFTAPXDAEFLLRGSM | 33 | N-terminal biotinylation (e.g. via TTDS_Lysin linker); C23S (to avoid aggregation) |
| 49 | CCR8 | HUMAN | LID | | DAELIQTNGK | 10 | NA |
| 50 | CCR8 | MACFA | LID | | DGELIQRNDK | 10 | NA |
| 51 | CCR8 | MOUSE | LID | | DAEFLLRGSM | 10 | NA |
| 52 | CCR8 | HUMAN | ECL1 | | YLLDQWVFGTVMCK | 14 | NA |
| 53 | CCR8 | MACFA | ECL1 | | YQLDQWVFGTVMCK | 14 | NA |
| 54 | CCR8 | MOUSE | ECL1 | | NLLDQWVFGTAMCK | 14 | NA |
| 55 | CCR8 | HUMAN | ECL2 | | YQVASEDGVLQCYSFYNQQTLKWKIFTNFKM | 31 | NA |
| 56 | CCR8 | MACFA | ECL2 | | YQVASEDGVLQCYSFYNQQTLKWKIFTNFEM | 31 | NA |
| 57 | CCR8 | MOUSE | ECL2 | | YQVASEDGMLQCFQFYEEQSLRWKLFTHFEI | 31 | NA |
| 58 | CCR8 | HUMAN | ECL3 | | HSMHILDGCSISQQLTY | 17 | NA |
| 59 | CCR8 | MACFA | ECL3 | | HSMHILDGCSISQQLNY | 17 | NA |
| 60 | CCR8 | MOUSE | ECL3 | | HDLHILDGCATRQRLAL | 17 | NA |
| 61 | CCR9 | HUMAN | TRD | Y17, Y28, Y37 | MTPTDFTSPIPNMADDYGSESTSSMEDYVNFNFTDFY | 37 | N-terminal biotinylation (e.g. via TTDS_Lysin linker) |
| 62 | CCR9 | MACFA | TRD | Y17, Y28, Y37 | MTPTEFTSPVPNMADDYGSESTSSMEDYVNFNFTDFY | 37 | N-terminal biotinylation (e.g. via TTDS_Lysin linker) |

TABLE 4.1-continued

Polypeptides for antigen or off target panning for generation of chemokine receptor antibodies. At least one sulfation at one of the listed tyrosine positions of the polypeptide is required according to the invention, but sulfations at two three or more sites are also possible and may be beneficial. X can be any amino acid or no amino acid, and preferably, is an amino acid different from cysteine, such as serine.

| SEQ ID NO: | Anti-gen | Species | Domain | Sulfation sites | Sequence | Length | Additional modifications (optional) |
|---|---|---|---|---|---|---|---|
| 63 | CCR9 | MOUSE | TRD | Y19, Y28 | MTPTEFTSPVPNMADDYGSESTSSMEDYVNFNFTDFY | 37 | N-terminal biotinylation (e.g. via TTDS_Lysin linker) |
| 64 | CCR9 | HUMAN | N term | Y17, Y28, Y37 | MTPTDFTSPIPNMADDYGSESTSSMEDYVNFNFTDFYXEKNNVRQFAS | 48 | N-terminal biotinylation (e.g. via TTDS_Lysin linker); C38S (to avoid aggregation) |
| 65 | CCR9 | MACFA | N term | Y17, Y28, Y37 | MTPTEFTSPVPNMADDYGSESTSSMEDYVNFNFTDFYXEKNNVRQFAS | 48 | N-terminal biotinylation (e.g. via TTDS_Lysin linker); C38S (to avoid aggregation) |
| 66 | CCR9 | MOUSE | N term | Y19, Y28 | MTPTEFTSPVPNMADDYGSESTSSMEDYVNFNFTDFYXEKNNVRQFAS | 48 | N-terminal biotinylation (e.g. via TTDS_Lysin linker); C38S (to avoid aggregation) |
| 67 | CCR10 | HUMAN | TRD | Y14, Y22 | MGTEATEQVSWGHYSGDEEDAYSAEPLPEL | 30 | N-terminal biotinylation (e.g. via TTDS_Lysin linker) |
| 68 | CCR10 | MACFA | TRD | Y14, Y22 | MGTEATEQVSWGHYSGDEEEAYSAEPLPEL | 30 | N-terminal biotinylation (e.g. via TTDS_Lysin linker) |
| 69 | CCR10 | MOUSE | TRD | Y14, Y17, Y22 | MGTKPTEQVSWGLYSGYDEEAYSVGPLPEL | 30 | N-terminal biotinylation (e.g. via TTDS_Lysin linker) |
| 70 | CCR10 | HUMAN | N term | Y14, Y22 | MGTEATEQVSWGHYSGDEEDAYSAEPLPELXYKADVQAFSRAFQPSVSLTVA | 52 | N-terminal biotinylation (e.g. via TTDS_Lysin linker); C31S (to avoid aggregation) |
| 71 | CCR10 | MACFA | N term | Y14, Y22 | MGTEATEQVSWGHYSGDEEEAYSAEPLPELXYKADVQAFSRAFQPSVSLTVA | 52 | N-terminal biotinylation (e.g. via TTDS_Lysin linker); C31S (to avoid aggregation) |
| 72 | CCR10 | MOUSE | N term | Y14, Y17, Y22 | MGTKPTEQVSWGLYSGYDEEAYSVGPLPELXYKADVQAFSRAFQPSVS | 48 | N-terminal biotinylation (e.g. via TTDS_Lysin linker); C31S (to avoid aggregation) |
| 73 | CXCR1 | HUMAN | TRD | Y27 | MSNITDPQMWDFDDLNFTGMPPADEDYSP | 29 | N-terminal biotinylation (e.g. via TTDS_Lysin linker) |
| 74 | CXCR1 | MACFA | TRD | Y14, Y28 | MSNATDPQMGDDDYDLNFTGMPPTDEDYSP | 30 | N-terminal biotinylation (e.g. via TTDS_Lysin linker) |
| 75 | CXCR1 | MOUSE | TRD | Y6, Y32 | MAEAEYFIWTNPEGDFEKEFGNITGMLPTGDYFIP | 35 | N-terminal biotinylation (e.g. via TTDS_Lysin linker) |
| 76 | CXCR1 | HUMAN | N term | Y27 | MSNITDPQMWDFDDLNFTGMPPADEDYSPXMLETETLNK | 39 | N-terminal biotinylation (e.g. via TTDS_Lysin linker); C30S (to avoid aggregation) |
| 77 | CXCR1 | MACFA | N term | Y14, Y28 | MSNATDPQMGDDDYDLNFTGMPPTDEDYSPXRLETQSLNK | 40 | N-terminal biotinylation (e.g. via TTDS_Lysin linker); C31S (to avoid aggregation) |
| 78 | CXCR1 | MOUSE | N term | Y6, Y32 | MAEAEYFIWTNPEGDFEKEFGNITGMLPTGDYFIPXKRVPITNR | 44 | N-terminal biotinylation (e.g. via TTDS_Lysin linker); C36S (to avoid aggregation) |
| 79 | CXCR2 | HUMAN | TRD | Y23, Y25 | MEDFNMESDSFEDFWKGEDLSNYSYSSTLPPFLLDAAP | 38 | N-terminal biotinylation (e.g. via TTDS_Lysin linker) |
| 80 | CXCR2 | MACMU | TRD | Y20, Y22 | FNMESDSFEDLWKGEDFSNYSYSSDLPPSLPDVAP | 35 | N-terminal biotinylation (e.g. via TTDS_Lysin linker) |
| 81 | CXCR2 | MOUSE | TRD | Y24 | MGEFKVDKFNIEDFFSGDLDIFNYSSGMPSILPDAVP | 37 | N-terminal biotinylation (e.g. via TTDS_Lysin linker) |
| 82 | CXCR2 | HUMAN | N term | Y23, Y25 | MEDFNMESDSFEDFWKGEDLSNYSYSSTLPPFLLDAAPXEPESLEINK | 48 | N-terminal biotinylation (e.g. via TTDS_Lysin linker); C39S (to avoid aggregation) |

TABLE 4.1-continued

Polypeptides for antigen or off target panning for generation of chemokine receptor antibodies. At least one sulfation at one of the listed tyrosine positions of the polypeptide is required according to the invention, but sulfations at two three or more sites are also possible and may be beneficial. X can be any amino acid or no amino acid, and preferably, is an amino acid different from cysteine, such as serine.

| SEQ ID NO: | Anti-gen | Species | Domain | Sulfation sites | Sequence | Length | Additional modifications (optional) |
|---|---|---|---|---|---|---|---|
| 83 | CXCR2 | MACMU | N term | Y20, Y22 | FNMESDSFEDLWKGEDFSNYSYSSDL PPSLPDVAPXRPESLEINK | 45 | N-terminal biotinylation (e.g. via TTDS_Lysin linker); C36S (to avoid aggregation) |
| 84 | CXCR2 | MOUSE | N term | Y24 | MGEFKVDKFNIEDFFSGDLDIFNYSSG MPSILPDAVPXHSENLEINS | 47 | N-terminal biotinylation (e.g. via TTDS_Lysin linker); C38S (to avoid aggregation) |
| 85 | CXCR3 | HUMAN | TRD | Y27, Y29 | MVLEVSDHQVLNDAEVAALLENFSS SYDYGENESDS | 36 | N-terminal biotinylation (e.g. via TTDS_Lysin linker) |
| 86 | CXCR3 | MACFA | TRD | Y27, Y29 | MVLEVSDHQVLNDAEVAALLENFSS SYDYGENESDS | 36 | N-terminal biotinylation (e.g. via TTDS_Lysin linker) |
| 87 | CXCR3 | MOUSE | TRD | Y2, Y27, Y29 | MYLEVSERQVLDASDFAFLLENSTSP YDYGENESDFSDSPP | 41 | N-terminal biotinylation (e.g. via TTDS_Lysin linker) |
| 88 | CXCR3 | HUMAN | N term | Y27, Y29 | MVLEVSDHQVLNDAEVAALLENFSS SYDYGENESDSXXTSPP | 42 | N-terminal biotinylation (e.g. via TTDS_Lysin linker); C37S, C38S (to avoid aggregation) |
| 89 | CXCR3 | MACFA | N term | Y27, Y29 | MVLEVSDHQVLNDAEVAALLENFSS SYDYGENESDSXXTSPP | 42 | N-terminal biotinylation (e.g. via TTDS_Lysin linker); C37S, C38S (to avoid aggregation) |
| 90 | CXCR3 | MOUSE | N term | Y2, Y27, Y29 | MYLEVSERQVLDASDFAFLLENSTSP YDYGENESDFSDSPPXPQDFSLNFDR | 52 | N-terminal biotinylation (e.g. via TTDS_Lysin linker); C42S (to avoid aggregation) |
| 91 | CXCR4 | HUMAN | TRD | (Y7), Y12, Y21 | MEGISIYTSDNYTEEMGSGDYDSMKE P | 27 | N-terminal biotinylation (e.g. via TTDS_Lysin linker) |
| 92 | CXCR4 | MACFA | TRD | (Y7), Y12, Y21 | MEGISIYTSDNYTEEMGSGDYDSIKEP | 27 | N-terminal biotinylation (e.g. via TTDS_Lysin linker) |
| 93 | CXCR4 | MOUSE | TRD | Y9, Y14, Y23 | MEPISVSIYTSDNYSEEVGSGDYDSN KEP | 29 | N-terminal biotinylation (e.g. via TTDS_Lysin linker) |
| 94 | CXCR4 | HUMAN | N term | (Y7), Y12, Y21 | MEGISIYTSDNYTEEMGSGDYDSMKE PXFREENANFNK | 38 | N-terminal biotinylation (e.g. via TTDS_Lysin linker); C28S (to avoid aggregation) |
| 95 | CXCR4 | MACFA | N term | (Y7), Y12, Y21 | MEGISIYTSDNYTEEMGSGDYDSIKEP XFREENAHFNR | 38 | N-terminal biotinylation (e.g. via TTDS_Lysin linker); C28S (to avoid aggregation) |
| 96 | CXCR4 | MOUSE | N term | Y9, Y14, Y23 | MEPISVSIYTSDNYSEEVGSGDYDSN KEPXFRDENVHFNR | 40 | N-terminal biotinylation (e.g. via TTDS_Lysin linker); C30S (to avoid aggregation) |
| 97 | CXCR5 | HUMAN | TRD | Y3, Y27 | MNYPLTLEMDLENLEDLFWELDRLD NYNDTSLVENHL | 37 | N-terminal biotinylation (e.g. via TTDS_Lysin linker) |
| 98 | CXCR5 | MACFA | TRD | Y3, Y27 | MNYPLMLEMDLENLEDLFLEFDKFD NYNDTSLVENHL | 37 | N-terminal biotinylation (e.g. via TTDS_Lysin linker) |
| 99 | CXCR5 | MOUSE | TRD | Y3, Y14, Y20, Y26 | MNYPLTLDMGSITYNMDDLYKELAF YSNSTEIPLQDSNF | 39 | N-terminal biotinylation (e.g. via TTDS_Lysin linker) |
| 100 | CXCR5 | HUMAN | N term | Y3, Y27 | MNYPLTLEMDLENLEDLFWELDRLD NYNDTSLVENHLXPATEGPLMASFK AVFVP | 55 | N-terminal biotinylation (e.g. via TTDS_Lysin linker); C38S (to avoid aggregation) |
| 101 | CXCR5 | MACFA | N term | Y3, Y27 | MNYPLMLEMDLENLEDLFLEFDKFD NYNDTSLVENHLXPATEGPLMASFK AVFVP | 55 | N-terminal biotinylation (e.g. via TTDS_Lysin linker); C38S (to avoid aggregation) |

TABLE 4.1-continued

Polypeptides for antigen or off target panning for generation of chemokine receptor antibodies. At least one sulfation at one of the listed tyrosine positions of the polypeptide is required according to the invention, but sulfations at two three or more sites are also possible and may be beneficial. X can be any amino acid or no amino acid, and preferably, is an amino acid different from cysteine, such as serine.

| SEQ ID NO: | Anti-gen | Species | Domain | Sulfation sites | Sequence | Length | Additional modifications (optional) |
|---|---|---|---|---|---|---|---|
| 102 | CXCR5 | MOUSE | N term | Y3, Y14, Y20, Y26 | MNYPLTLDMGSITYNMDDLYKELAFYSNSTEIPLQDSNFXSTVEGPLLTSFKAVFMP | 57 | N-terminal biotinylation (e.g. via TTDS_Lysin linker); C40S (to avoid aggregation) |
| 103 | CXCR6 | HUMAN | TRD | Y6, Y10 | MAEHDYHEDYGFSSFNDSSQEEHQDFLQFSKV | 32 | N-terminal biotinylation (e.g. via TTDS_Lysin linker) |
| 104 | CXCR6 | MACFA | TRD | Y4 Y7, Y39 | MAEYDHYEDDGFLNSFNDSSQEEHQDFLQFRKV | 33 | N-terminal biotinylation (e.g. via TTDS_Lysin linker) |
| 105 | CXCR6 | MOUSE | TRD | Y11, (Y15) | MDDGHQESALYDGHYEGDFWLFNNSSDNSQENKRFLKFKEV | 41 | N-terminal biotinylation (e.g. via TTDS_Lysin linker) |
| 106 | CXCR6 | HUMAN | N term | Y6, Y10 | MAEHDYHEDYGFSSFNDSSQEEHQDFLQFSKVFLPXMYLVVFV | 43 | N-terminal biotinylation (e.g. via TTDS_Lysin linker); C33S (to avoid aggregation) |
| 107 | CXCR6 | MACFA | N term | Y4, Y7, Y39 | MAEYDHYEDDGFLNSFNDSSQEEHQDFLQFRKVFLPXMYLVVFV | 44 | N-terminal biotinylation (e.g. via TTDS_Lysin linker); C34S (to avoid aggregation) |
| 108 | CXCR6 | MOUSE | N term | Y11, (Y15) | MDDGHQESALYDGHYEGDFWLFNNSSDNSQENKRFLKFKEVFLPX | 45 | N-terminal biotinylation (e.g. via TTDS_Lysin linker); C42S (to avoid aggregation) |
| 157 | CX3CR1 | HUMAN | TRD | Y14 | MDQFPESVTENFEYDDLAEA | 20 | N-terminal biotinylation (e.g. via TTDS_Lysin linker) |
| 158 | CX3CR1 | MACFA | TRD | Y20 | LRNVEANFLGFLLPLLIMSY | 20 | N-terminal biotinylation (e.g. via TTDS_Lysin linker) |
| 159 | CX3CR1 | MOUSE | TRD | Y15 | MSTSFPELDLENFEYDDSAEA | 21 | N-terminal biotinylation (e.g. via TTDS_Lysin linker) |
| 160 | CX3CR1 | HUMAN | N term | Y14, Y22 | MDQFPESVTENFEYDDLAEAXYIGDIVVFGT | 31 | N-terminal biotinylation (e.g. via TTDS_Lysin linker); C21S (to avoid aggregation) |
| 161 | CX3CR1 | MACFA | N term | Y20, Y22 | LRNVEANFLGFLLPLLIMSYXYFRIIQTLFS | 31 | N-terminal biotinylation (e.g. via TTDS_Lysin linker); C21S (to avoid aggregation) |
| 162 | CX3CR1 | MOUSE | N term | Y15, Y23 | MSTSFPELDLENFEYDDSAEAXYLGDIVAFGT | 32 | N-terminal biotinylation (e.g. via TTDS_Lysin linker); C22S (to avoid aggregation) |
| 163 | CXCR1 | HUMAN | TRD | Y27 | MSNITDPQMWDFDDLNFTGMPPADEDYSP | 29 | N-terminal biotinylation (e.g. via TTDS_Lysin linker) |
| 164 | CXCR1 | MACMU | TRD | Y14, Y28 | MSNATDPQMGDDDYDLNFTGMPPTDEDYSP | 30 | N-terminal biotinylation (e.g. via TTDS_Lysin linker) |
| 165 | CXCR1 | MOUSE | TRD | Y6, Y32 | MAEAEYFIWTNPEGDFEKEFGNITGMLPTGDYFIP | 35 | N-terminal biotinylation (e.g. via TTDS_Lysin linker) |
| 166 | CXCR1 | HUMAN | N term | Y27 | MSNITDPQMWDFDDLNFTGMPPADEDYSPXMLETETLNK | 39 | N-terminal biotinylation (e.g. via TTDS_Lysin linker); C30S (to avoid aggregation) |
| 167 | CXCR1 | MACMU | N term | Y14, Y28, Y41 | MSNATDPQMGDDDYDLNFTGMPPTDEDYSPXRLETQSLNKYVVIVT | 46 | N-terminal biotinylation (e.g. via TTDS_Lysin linker); C31S (to avoid aggregation) |
| 168 | CXCR1 | MOUSE | N term | Y6, Y32 | MAEAEYFIWTNPEGDFEKEFGNITGMLPTGDYFIPXKRVPITNR | 44 | N-terminal biotinylation (e.g. via TTDS_Lysin linker); C36S (to avoid aggregation) |

TABLE 5.1

Polypeptides synthesized for CCR8 as target

| ID | Anti-gen | Species | Domain | Sulfation | Additional modifications |
|---|---|---|---|---|---|
| TPP-13798 | CCR8 | cyno | Lid | — | C-terminal biotinylation (e.g. via TTDS linker) |
| TPP-13796 | CCR8 | human | Lid | — | C-terminal biotinylation (e.g. via TTDS linker) |
| TPP-13797 | CCR8 | mouse | Lid | — | C-terminal biotinylation (e.g. via TTDS linker) |
| TPP-13794 | CCR8 | cyno | TRD | — | N-terminal biotinylation (e.g. via TTDS_Lysin linker) |
| TPP-13795 | CCR8 | cyno | TRD | Y3, Y15, Y17 | N-terminal biotinylation (e.g. via TTDS_Lysin linker) |
| TPP-13791 | CCR8 | human | TRD | — | N-terminal biotinylation (e.g. via TTDS_Lysin linker) |
| TPP-13792 | CCR8 | mouse | TRD | — | N-terminal biotinylation (e.g. via TTDS_Lysin linker) |
| TPP-13793 | CCR8 | mouse | TRD | Y3, Y14, Y15 | N-terminal biotinylation (e.g. via TTDS_Lysin linker) |
| TPP-13965 | CCR8 | cyno | N-term | — | N-terminal biotinylation (e.g. via TTDS_Lysin linker); C25S (to avoid aggregation) |
| TPP-14828 | CCR8 | cyno | N term | Y3, Y15, Y17 | N-terminal biotinylation (e.g. via TTDS_Lysin linker); C25S (to avoid aggregation) |
| TPP-13963 | CCR8 | human | N term | — | N-terminal biotinylation (e.g. via TTDS_Lysin linker); C25S (to avoid aggregation) |
| TPP-14827 | CCR8 | human | N term | Y3, Y15, Y17 | N-terminal biotinylation (e.g. via TTDS_Lysin linker); C25S (to avoid aggregation) |
| TPP-13964 | CCR8 | mouse | N term | — | N-terminal biotinylation (e.g. via TTDS_Lysin linker); C23S (to avoid aggregation) |
| TPP-14830 | CCR8 | mouse | N term | Y3, Y14, | N-terminal biotinylation (e.g. via TTDS_Lysin linker); C23S (to avoid aggregation) |

To test if posttranslational modifications of proteins were causing the difficulties for the antibody generation, peptides comprising TRD and/or N term sequences were used, which were either unmodified or sulfated. Sulfation on the cynomolgus and human TRD of CCR8 were introduced on at least 50% of the tyrosines, e.g. on the positions 3, 15 and 17 of the respective peptides. For the mouse TRD and N term peptides, sulfations were introduced on the tyrosines at position 3, 14 and 15 of the respective peptides (cf. Table 6.1). In addition, peptides comprising the LID where engineered by introduction of a C-terminal biotinylation that was attached via a TTDS (Trioxatridecan-succinamic acid) linker. Other tags and linkers can also be used. The peptides for the TRD or N term were modified by introduction of a N-terminal biotinylation attached via a TTDS-Lysin linker. Again, further known linker and/or tags can likewise be used to facilitate immobilization of the peptides.

Peptide Synthesis

Peptides can be obtained from different commercial sources and can be prepared as known in the art, for example using standard Fmoc solid-phase peptide synthesis (SPPS) chemistry. The efficient synthesis of sulfated peptides is technically challenging as tyrosine-sulfated peptides are stable under basic conditions, while the sulfotyrosines undergo desulfation under acidic conditions rendering the simple stepwise incorporation of FmocTyr(SO3Na)OH into the growing peptide unsuitable. Global sulfation of peptides is possible, for example using sulfur trioxide-pyridine, but does not allow for specific sulfation of selected tyrosines. However, Fmoc-based SSPS can nevertheless be used for synthesis of sulfated peptides. To this end orthogonally protected tyrosine derivatives like fluorosulfated tyrosine, azidomethyl protected tyrosine or neopentyl-protected tyrosine may be used for incorporation. The protected tyrosine can be subsequently unmasked in a selective and quantitative way.

Chen et al., Angew Chem, 2016, have reported a one-step synthesis of Fmoc-fluorosulfated tyrosine. An efficient Fmoc solid-phase peptide synthesis strategy is then introduced for incorporating the fluorosulfated tyrosine residue into peptides of interest. Standard simultaneous peptide-resin cleavage and removal of the acid-labile side-chain protecting groups affords the crude peptides containing fluorosulfated tyrosine. Basic ethylene glycol, serving as solvent and reactant, transforms the fluorosulfated tyrosine peptides into sulfotyrosine peptides in high yield.

The resulting peptides can be subsequently purified as known in the art, e.g. by HPLC, e.g. on a BEH C-18 (Waters) or a Kinetex C-18 (Phenomenex) column and can be analyzed by mass spectrometry (IonSpray and Positive Ion Detector), e.g. for quality control.

In literature, two disulfide bridges within the full length human CCR8 protein have been described to connect the extracellular loop 1 (ECL1) and extracellular loop 2 (ECL2) via the cysteines on positions 106 and 183. A further disulfide bridge between cysteines 25 and 272 is assumed to connect the 7$^{th}$ transmembrane helix with the N-terminus. However, the peptides according to the example are not expected to form any disulfide bridges between cysteines.

Example 6: Phage Display and Human Anti-CCR8 Antibody Screening

A fully human antibody phage display library (BioInvent n-CoDeR Fab lambda library) was used to isolate human monoclonal antibodies by selection against soluble biotinylated peptides. Peptides were provided by Pepscan. The synthesis of peptides was performed as described in example 5. For the panning procedure the following protocol was applied.

TABLE 6.1

List of peptides including modifications used for antibody selection by phage display and ELISA screening.

| ID | Anti-gen | Species | D$_0$-main | Sulfation | Additional modifications |
|---|---|---|---|---|---|
| TPP-14828 | CCR8 | cyno | N term | Y3, Y15, Y17 | N-terminal biotinylation via TTDS_Lysin linker; C25S (to avoid aggregation) |
| TPP-14827 | CCR8 | human | N term | Y3, Y15, Y17 | N-terminal biotinylation via TTDS_Lysin linker; C25S (to avoid aggregation) |

TABLE 6.1-continued

List of peptides including modifications used for antibody selection by phage display and ELISA screening.

| ID | Antigen | Species | D₀-main | Sulfation | Additional modifications |
|---|---|---|---|---|---|
| TPP-14829 (off-target) | CCR4 | human | N term | Y22 | N-terminal biotinylation via TTDS_Lysin linker; C29S (to avoid aggregation) |

Streptavidin-coupled Dynabeads M-280 (Invitrogen™) were coated for one hour at room temperature (RT) with the biotinylated peptide (1 tube) and the biotinylated off-target peptide (3 tubes), respectively. Dynabeads were washed and subsequently blocked for 1 h at RT with end-over-end rotation.

For depletion of off-target binders, the blocked phage library was added to the blocked off-target loaded Dynabeads and incubated for 10 min at room temperature with end-over-end rotation. This depletion step was repeated 2 times. The depleted phage library was added to the blocked target loaded Dynabeads and incubated for 60 min at RT with end-over-end rotation.

After stringent washing (3× in blocking buffer (PBS-T, 3% milk powder) and 9× in PBS-T (150 mM NaCl; 8 mM Na2HPO4; 1.5 mM KH2PO4; adjusted to pH=7.4-7.6, 0.05% Tween-20)), Dynabeads with Fab-phages binding specifically to the coated target were directly used to infect E. coli strain HB101. Subsequently the phages were amplified in E. coli strain HB101 using M13K07 Helper Phage (Invitrogen).

Figure 4:
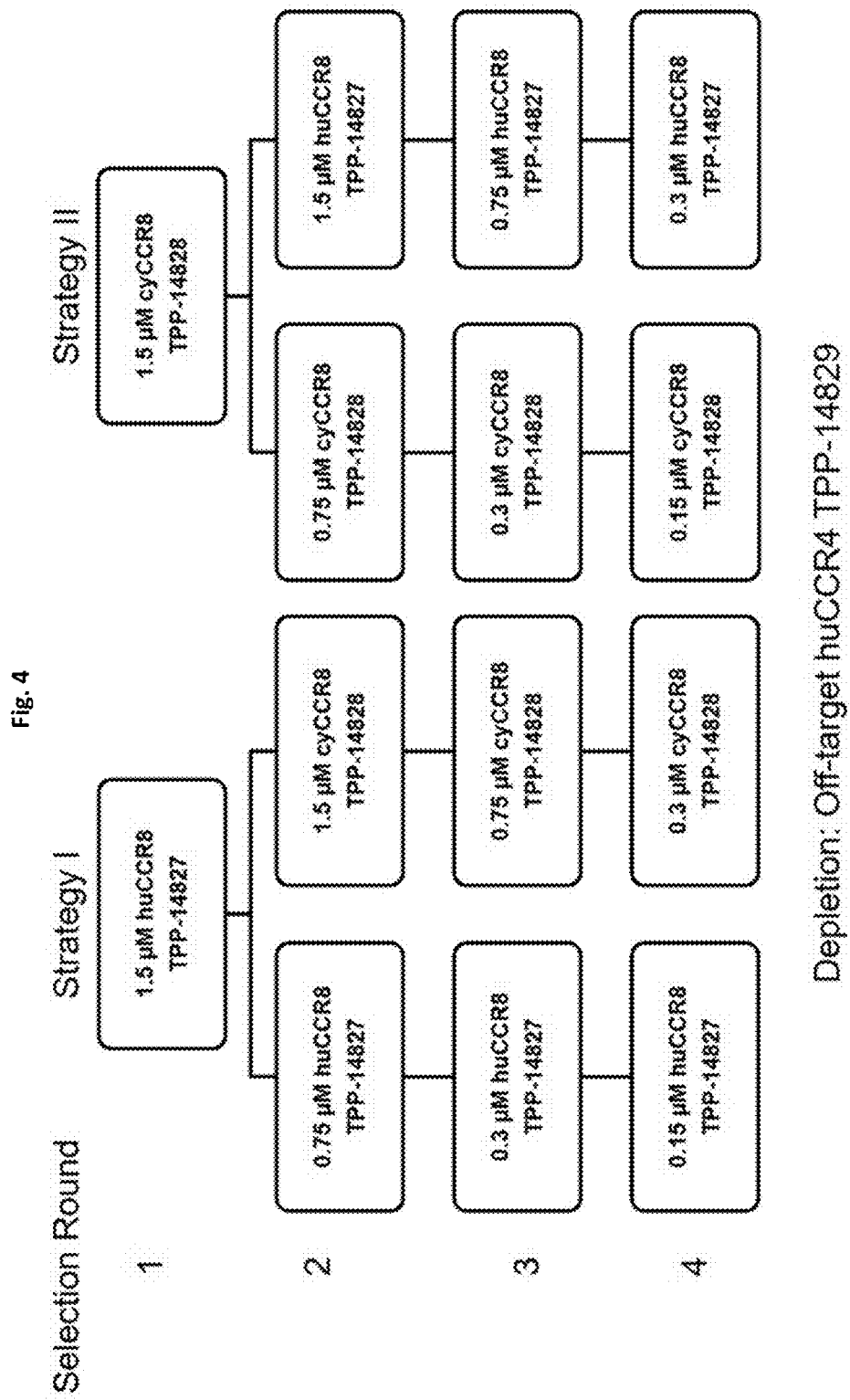
FIG. 4: Panning strategy for lead finding: Two major strategies for selections on sulfated peptides are depicted. In all strategies, prior to each round of selection a depletion step on a relevant or an irrelevant biotinylated protein was included.

In the following selection rounds the target concentration was decreased to augment the selection pressure for high affinity binders. During panning of the library, two different selection strategies were carried out (FIG. 4). The strategies were designed to identify antibodies exhibiting binding activity towards the human CCR8 N-terminal region comprising the TRD and/or the cynomolgus CCR8 N-terminal region comprising the TRD. All peptides used as antigens or for off target panning were sulfated in at least one position, cf. Table 4.1. and Table 6.1.

For both strategies, a depletion step was included using biotinylated human CCR4 N-terminal region comprising the TRD (TPP-14829, SEQ ID NO:22, with Y22 being sulfated) as off-target peptide. Strategy I comprised a first panning round on the human CCR8 N-terminal, sulfated peptide (TPP-14827, SEQ ID NO:46, with Y3, Y15, Y17 being sulfated) followed by either 3 rounds on the same peptide (TPP-14827, SEQ ID NO:46 with Y3, Y15, Y17 being sulfated) or on the cynomolgus CCR8 N-terminal, sulfated peptide (TPP-14828, SEQ ID NO:47 with Y3, Y15, Y17 being sulfated).

Strategy II comprised a first panning round on the cynomolgus CCR8 N-terminal, sulfated peptide (TPP-14828, SEQ ID NO:47 with Y3, Y15, Y17 being sulfated) followed by either 3 rounds on the same peptide (TPP-14828, SEQ ID NO:47 with Y3, Y15, Y17 being sulfated) or three rounds on the human CCR8 N-terminal, sulfated peptide (TPP-14827, SEQ ID NO:46 with Y3, Y15, Y17 being sulfated), as depicted in FIG. 4.

For a first qualitative assessment, for each clone pool monoclonal cultivation and expression of 88 randomly picked Fab-on-phage clones was performed and clones were subsequently tested for binding to the respective target previously used for panning. In addition, binding to human and cynomolgus CCR8 expressing cells was determined by flow cytometry (FACS).

A specific binder is defined in the particular context as a molecule showing
 (i) in the ELISA assay a signal intensity for the target which is at least 10 times higher than the signal intensity for the off-target,
 (ii) in FACS assay a signal for the CCR8 expressing cell lines which is at least 2 times higher than the signal for a control cell line not expressing CCR8, and
 (iii) in FACS assay a signal on the control cell line which is smaller than 10000.

Plasmid-DNA from 12 pools with significant hit rates in at least one of the two assays was submitted to gene III removal and the resulting soluble Fabs were screened in a high throughput ELISA and FACS screening.

Example 7: High Throughput Screening for Human Anti-Human CCR8 Antibodies

From the 12 clone pools generated during phage display, 17000 different sFab clones were screened in a high throughput screening by ELISA (HTS-ELISA) to determine their binding to the peptides that were previously used for phage display panning, namely (i) TPP-14827, SEQ ID NO:46, with Y3, Y15, Y17 being sulfated, (ii) TPP-14828, SEQ ID NO:47 with Y3, Y15, Y17 being sulfated and (iii) the respective off-target peptide TPP-14829, SEQ ID NO:22, with Y22 being sulfated. For ELISA screening, the peptides were immobilized on streptavidin coated plates (Greiner bio-one 781997) with a concentration of 0.1 µg/ml at 4° C. in coating buffer (Carbonat-Basis, Candor 121125). After washing the plates 3 times with 60 µl PBS 0.05% Tween and blocking with 50 µl Smart Block® (Candor 113500) for 1 h at 20° C., 10 µl sFab samples were added to the plates and incubated at 20° C. for 1 h. After subsequent washing with 60 µl PBS 0.05% Tween for 3 times, 20 µl of an anti-c-Myc HRP antibody were added and incubated for 1 h at 20° C. followed by subsequent washing 3 times with 60 µl PBS 0.05% Tween and addition of 20 µl Amplex Red solution (Invitrogen A12222, 1:1000 in NaP-buffer 50 mM pH7.6 with 1:10000 of 30% H2O2). After final incubation for 20 min at 20° C. the signal was determined using an emission wavelength of 595 nm and an excitation wavelength of 530 nm. For analysis, the signal to background ratio of the single sFab clones was used whereas the background is defined by the average value of 48 wells on each plate, not containing any sFab culture but the respective sample medium.

In total 2193 different sFab clones showed significant binding to both human and cynomolgus N-terminal, sulfated peptides TPP-14827 (SEQ ID NO:46, with Y3, Y15, Y17 being sulfated) and TPP-14828 (SEQ ID NO:47 with Y3, Y15, Y17 being sulfated) as indicated by a signal to background ratio bigger than 5 while not demonstrating any significant binding to the off target TPP-14829 (SEQ ID NO:22 with Y22 being sulfated). These sFab clones were reformatted into full length human IgG1 antibodies and applied to FACS screening on human and cynomolgus CCR8 expressing cell lines.

Based on binding to both, cynomolgus as well as human CCR8 expressing cells as well as not demonstrating any significant unspecific binding to a parental cell line not expressing CCR8, ten antibody clones were selected for production and further characterization. These initial hits were TPP-17575 to TPP-17581 and TPP-18205 to TPP-18207, the CDRs are shown in Table 7.1. Antibodies were further manually optimized for applicability in therapy to yield the set of antibodies shown in Table 7.2 a and Table 7.2 b, cf. also sequence listing.

Furthermore, in order to obtain antibody TPP-27495, the sequences of TPP-23411 were engineered to comprise YTE mutations M252Y, S254T and T256E. TPP-27495 is 70% afucosylated.

Furthermore, in order to obtain antibody TPP-27496, the sequences of TPP-23411 were engineered to comprise LS mutations M428L and N434S. TPP-27496 is 70% afucosylated.

Example 8: Generation of Anti-Murine CCR8 Antibodies

Phage Display and Antibody Screening

A fully human antibody phage display library (BioInvent n-CoDeR Fab lambda library) was used to isolate human monoclonal antibodies recognizing murine CCR8 by selection against soluble biotinylated peptides. Peptides were provided by Pepscan. The synthesis of peptides was performed as described elsewhere herein. For the panning procedure the following protocol was applied.

Streptavidin-coupled Dynabeads M-280 (Invitrogen™) were coated for one hour at room temperature (RT) with the biotinylated peptide (1 tube) and the biotinylated off-target peptide (3 tubes), respectively. Dynabeads were washed and subsequently blocked for 1 h at RT with end-over-end rotation. For depletion of off-target binders, the blocked phage library was added to the blocked off-target loaded Dynabeads and incubated for 10 min at room temperature with end-over-end rotation. This depletion step was repeated 2 times. The depleted phage library was added to the blocked target loaded Dynabeads and incubated for 60 min at RT with end-over-end rotation.

After stringent washing (3× in blocking buffer (PBS-T, 3% milk powder) and 9× in PBS (150 mM NaCl; 8 mM Na2HPO4; 1.5 mM KH2PO4; adjusted to pH=7.4-7.6) with 0.05% Tween-20)), Dynabeads with Fab-phages binding specifically to the coated target were directly used to infect *E. coli* strain HB101. Subsequently the phages were amplified in *E. coli* strain HB101 using M13KO7 Helper Phage (Invitrogen™).

In the following selection rounds the target concentration was decreased to augment the selection pressure for high affinity binders.

TABLE 7.1

CDRs for specific human anti-human CCR8 candidate antibodies obtained with the method according to the current invention.

| Identifier | LCDR1 | LCDR2 | LCDR3 | HCDR1 | HCDR2 | HCDR3 |
|---|---|---|---|---|---|---|
| TPP-17575 | SGSSSNIGNNYVS (SEQ ID NO: 280) | GNSNRPS (SEQ ID NO: 281) | QTWGTGIRV (SEQ ID NO: 282) | SYAMH (SEQ ID NO: 276) | LISWDGGSTYYADSVKG (SEQ ID NO: 277) | GGIGRRPGLEY (SEQ ID NO: 278) |
| TPP-17576 | SGSSSNIGNNAVN (SEQ ID NO: 298) | RNNQRSS (SEQ ID NO: 299) | QSYDNSLSASV (SEQ ID NO: 300) | SYAMS (SEQ ID NO: 294) | RIRSKANSYATAYAASVKG (SEQ ID NO: 295) | PLDS (SEQ ID NO: 296) |
| TPP-17577 | SGSSSNIGSNTVN (SEQ ID NO: 316) | RNNQRPS (SEQ ID NO: 317) | AAWDDSLKALV (SEQ ID NO: 318) | NAWMS (SEQ ID NO: 312) | VISYDGRNKYSADSVKG (SEQ ID NO: 313) | GLPYGY (SEQ ID NO: 314) |
| TPP-17578 | SGSSSNIGSHTVN (SEQ ID NO: 334) | RNNQRPS (SEQ ID NO: 335) | AAWDDSLNGWV (SEQ ID NO: 336) | NAWMS (SEQ ID NO: 330) | GINWNGGSTGYADSVKG (SEQ ID NO: 331) | TYSGHYGPYFDN (SEQ ID NO: 332) |
| TPP-17579 | SGSWSNIGNDNVY (SEQ ID NO: 352) | RNNQRPS (SEQ ID NO: 353) | QSYDRSLSGSV (SEQ ID NO: 354) | TYWMT (SEQ ID NO: 348) | GVSWNGSRTHYVDSVKR (SEQ ID NO: 349) | YSGYPDYYGMDV (SEQ ID NO: 350) |
| TPP-17580 | SGSSSNIGSYPVN (SEQ ID NO: 370) | RNNQRPS (SEQ ID NO: 371) | SSYSVTDNLI (SEQ ID NO: 372) | SYGMH (SEQ ID NO: 366) | GVSWNGSRTRYADSVKG (SEQ ID NO: 367) | GSYNSGWYAVS (SEQ ID NO: 368) |
| TPP-17581 | TGSSSNIGAGYDVH (SEQ ID NO: 388) | SHNQRPS (SEQ ID NO: 389) | SAWDSSLSAWV (SEQ ID NO: 390) | NYRMT (SEQ ID NO: 384) | GINWNGGSTGYADSVKG (SEQ ID NO: 385) | GRFDTRGFYGFDY (SEQ ID NO: 386) |
| TPP-18205 | SGGNSNIGTYFVS (SEQ ID NO: 406) | TNNQRPS (SEQ ID NO: 407) | ETWDSNTRV (SEQ ID NO: 408) | SYAMS (SEQ ID NO: 402) | GIRWNSGSKGYAGSVKG (SEQ ID NO: 403) | SGNYYVGYHGMDV (SEQ ID NO: 404) |
| TPP-18206 | TGSSSNIGAGYNVH (SEQ ID NO: 424) | TNNRRPS (SEQ ID NO: 425) | AAWDASLSGWV (SEQ ID NO: 426) | HYGMH (SEQ ID NO: 420) | GINWNGGSTGYADSVKG (SEQ ID NO: 421) | GHHSGYDGRFFDY (SEQ ID NO: 422) |

TABLE 7.1-continued

CDRs for specific human anti-human CCR8 candidate antibodies obtained with the method according to the current invention.

| Identifier | LCDR1 | LCDR2 | LCDR3 | HCDR1 | HCDR2 | HCDR3 |
|---|---|---|---|---|---|---|
| TPP-18207 | TGSSSNIGAGYDVH (SEQ ID NO: 442) | KNNQRPS (SEQ ID NO: 443) | AAWDDSLRGWV (SEQ ID NO: 444) | NAWMS (SEQ ID NO: 438) | GINWNGGSTGYADSVKG (SEQ ID NO: 439) | TYTGNYGPYFDY (SEQ ID NO: 440) |

TABLE 7.2 a

CDRs for specific human anti-human CCR8 candidate antibodies according to the current invention having superior therapeutic profile.

| Identifier | LCDR1 | LCDR2 | LCDR3 | HCDR1 | HCDR2 | HCDR3 |
|---|---|---|---|---|---|---|
| TPP-16966 | SGSSSNIGSHIVN (SEQ ID NO: 262) | GNTNRPS (SEQ ID NO: 263) | SSYTSISTLV (SEQ ID NO: 264) | SYSMN (SEQ ID NO: 258) | GVSWAGSRTHYADSVKG (SEQ ID NO: 259) | AAAGTRGFDY (SEQ ID NO: 260) |
| TPP-17546 | SGSSSNIGSHTVN (SEQ ID NO: 532) | RNNQRPS (SEQ ID NO: 533) | AAWDDSLNGWV (SEQ ID NO: 534) | SAWMS (SEQ ID NO: 456) | GISWSGGSTGYADSVKG (SEQ ID NO: 457) | TYSGHYGPYFDY (SEQ ID NO: 458) |
| TPP-17578 | SGSSSNIGSHTVN (SEQ ID NO: 334) | RNNQRPS (SEQ ID NO: 335) | AAWDDSLNGWV (SEQ ID NO: 336) | NAWMS (SEQ ID NO: 330) | GINWNGGSTGYADSVKG (SEQ ID NO: 331) | TYSGHYGPYFDN (SEQ ID NO: 332) |
| TPP-18205 | SGGNSNIGTYFVS (SEQ ID NO: 406) | TNWDSNTRV (SEQ ID NO: 407) | ETWDSNTRV (SEQ ID NO: 408) | SYAMS (SEQ ID NO: 402) | GIRWNSGSKGYAGSVKG (SEQ ID NO: 403) | SGNYYVGYHGMDV (SEQ ID NO: 404) |
| TPP-18206 | TGSSSNIGAGYNVH (SEQ ID NO: 424) | TNNRRPS (SEQ ID NO: 425) | AAWDASLSGWV (SEQ ID NO: 426) | HYGMH (SEQ ID NO: 420) | GINWNGGSTGYADSVKG (SEQ ID NO: 421) | GHHSGYDGRFFDY (SEQ ID NO: 422) |
| TPP-19546 | SGSSSNIGSHTVN (SEQ ID NO: 460) | RNNQRPS (SEQ ID NO: 461) | AAWDDSLNGWV (SEQ ID NO: 462) | SAWMS (SEQ ID NO: 456) | GISWSGGSTGYADSVKG (SEQ ID NO: 457) | TYSGHYGPYFDY (SEQ ID NO: 458) |
| TPP-20950 | TGSSSNIGAGYNVH (SEQ ID NO: 478) | TNNRRPS (SEQ ID NO: 479) | AAWDASLSGWV (SEQ ID NO: 480) | SYGMH (SEQ ID NO: 474) | AIKWGGGSHGYADSVKG (SEQ ID NO: 475) | GHHSGKDGRFFDY (SEQ ID NO: 476) |
| TPP-20955 | TGSSSNIGAGYNVH (SEQ ID NO: 496) | TNNRRPS (SEQ ID NO: 497) | AAWDASLSGWV (SEQ ID NO: 498) | SYGMH (SEQ ID NO: 492) | AIKWGGGSHGYADSVKG (SEQ ID NO: 493) | GHHKGYDGRFFDY (SEQ ID NO: 494) |
| TPP-20965 | TGSSSNIGAGYNVH (SEQ ID NO: 514) | TNNRRPS (SEQ ID NO: 515) | AAWDASLSGWV (SEQ ID NO: 516) | SYGMH (SEQ ID NO: 510) | AIKWGGGSTGYADSVKG (SEQ ID NO: 511) | GHHSGKDGRFFDY (SEQ ID NO: 512) |
| TPP-21045 | SGSSSNIGSHTVN (SEQ ID NO: 532) | RNNQRPS (SEQ ID NO: 533) | AAWDDSLNGWV (SEQ ID NO: 534) | SAWMS (SEQ ID NO: 528) | GISWSGGSTGYALSVKG (SEQ ID NO: 529) | TYSGHYGPFFDY (SEQ ID NO: 530) |
| TPP-21047 | SGSSSNIGSHTVN (SEQ ID NO: 550) | RNNQRPS (SEQ ID NO: 551) | AAWDDSLNGWV (SEQ ID NO: 552) | SAWMS (SEQ ID NO: 546) | GISWSGGRTGYALSVKG (SEQ ID NO: 547) | TYSGHYGPYFDY (SEQ ID NO: 548) |
| TPP-21181 | SGGNSNIGTYFVS (SEQ ID NO: 568) | TNNQROS (SEQ ID NO: 569) | ETWDSNTRV (SEQ ID NO: 570) | SYAMS (SEQ ID NO: 564) | GIRWNNGSKGYAGSVKG (SEQ ID NO: 565) | SGNYYYGYHGMDV (SEQ ID NO: 566) |
| TPP-21183 | SGGNSNIGTYFVS (SEQ ID NO: 586) | TNNQRPS (SEQ ID NO: 587) | ETWDSNTRV (SEQ ID NO: 588) | SYAMS (SEQ ID NO: 582) | GIRWNNGSKGYAGSVKG (SEQ ID NO: 583) | SGNEYYGYHGMDV (SEQ ID NO: 584) |
| TPP-23411 | TGSSSNIGAGYNVH (SEQ ID NO: 622) | TNNRRPS (SEQ ID NO: 623) | AAWDASLSGWV (SEQ ID NO: 624) | SYGMH (SEQ ID NO: 618) | AINWNGGSTGYADSVKG (SEQ ID NO: 619) | GHHSGYDGRFFDY (SEQ ID NO: 620) |

TABLE 7.2 b

CDRs for anti-human CCR8 candidate antibodies derived from TPP-23411.

| Identifier | Mutation | LCDR1 | LCDR2 | LCDR3 | HCDR1 | HCDR2 | HCDR3 |
|---|---|---|---|---|---|---|---|
| TPP-29596 | VL: A10V, T13A; VH: H31S; C-terminal K | TGSSSNIGAGYNVH (SEQ ID NO: 665) | TNNRRPS (SEQ ID NO: 666) | AAWDASLSGWV (SEQ ID NO: 667) | SYGMH (SEQ ID NO: 661) | GINWNGGSTGYADSVKG (SEQ ID NO: 662) | GHIHSGYDGRFFDY (SEQ ID NO: 663) |
| TPP-29597 | VL: T13; VH: H31S, G50A; C-terminal K | TGSSSNIGAGYNVH (SEQ ID NO: 685) | TNNRRPS (SEQ ID NO: 686) | AAWDASLSGWV (SEQ ID NO: 687) | SYGMH (SEQ ID NO: 681) | AINWNGGSTGYADSVKG (SEQ ID NO: 682) | GHIHSGYDGRFFDY (SEQ ID NO: 683) |
| TPP-18429 | VL: A10V | TGSSSNIGAGYNVH (SEQ ID NO: 707) | TNNRRPS (SEQ ID NO: 708) | AAWDASLSGWV (SEQ ID NO: 709) | HYGMH (SEQ ID NO: 703) | GINWNGGSTGYADSVKG (SEQ ID NO: 704) | GHIHSGYDGRFFDY (SEQ ID NO: 705) |
| TPP-18430 | VL: T13A | TGSSSNIGAGYNVH (SEQ ID NO: 727) | TNNRRPS (SEQ ID NO: 728) | AAWDASLSGWV (SEQ ID NO: 729) | HYGMH (SEQ ID NO: 723) | GINWNGGSTGYADSVKG (SEQ ID NO: 724) | GHHSGYDGRFFDY (SEQ ID NO: 725) |
| TPP-18432 | VL: A10V, T13A | TGSSSNIGAGYNVH (SEQ ID NO: 747) | TNNRRPS (SEQ ID NO: 748) | AAWDASLSGWV (SEQ ID NO: 749) | HYGMH (SEQ ID NO: 743) | GINWNGGSTGYADSVKG (SEQ ID NO: 744) | GHHSGYDGRFFDY (SEQ ID NO: 745) |
| TPP-18433 | VH: H31S | TGSSSNIGAGYNVH (SEQ ID NO: 767) | TNNRRPS (SEQ ID NO: 768) | AAWDASLSGWV (SEQ ID NO: 769) | SYGMH (SEQ ID NO: 763) | GINWNGGSTGYADSVKG (SEQ ID NO: 764) | GHHSGYDGRFFDY (SEQ ID NO: 765) |
| TPP-18436 | VH: G50A | TGSSSNIGAGYNVH (SEQ ID NO: 787) | TNNRRPS (SEQ ID NO: 788) | AAWDASLSGWV (SEQ ID NO: 789) | HYGMH (SEQ ID NO: 783) | AINWNGGSTGYADSVKG (SEQ ID NO: 784) | GHHSGYDGRFFDY (SEQ ID NO: 785) |
| TPP-19571 | VH: H31S, G50A | TGSSSNIGAGYNVH (SEQ ID NO: 807) | TNNRRPS (SEQ ID NO: 808) | AAWDASLSGWV (SEQ ID NO: 809) | SYGMH (SEQ ID NO: 803) | AINWNGGSTGYADSVKG (SEQ ID NO: 804) | GHHSGYDGRFFDY (SEQ ID NO: 805) |
| TPP-27477 | VL: A10V; VH: H31S, G50A | TGSSSNIGAGYNVH (SEQ ID NO: 831) | TNNRRPS (SEQ ID NO: 832) | AAWDASLSGWV (SEQ ID NO: 833) | SYGMH (SEQ ID NO: 827) | AINWNGGSTGYADSVKG (SEQ ID NO: 828) | GHHSGYDGRFFDY (SEQ ID NO: 829) |
| TPP-27478 | VL: T13A; VH: H31S, G50A | TGSSSNIGAGYNVH (SEQ ID NO: 851) | TNNRRPS (SEQ ID NO: 852) | AAWDASLSGWV (SEQ ID NO: 853) | SYGMH (SEQ ID NO: 847) | AINWNGGSTGYADSVKG (SEQ ID NO: 848) | GHHSGYDGRFFDY (SEQ ID NO: 849) |
| TPP-27479 | VL: A10V, T13A; VH: H31S | TGSSSNIGAGYNVH (SEQ ID NO: 871) | TNNRRPS (SEQ ID NO: 872) | AAWDASLSGWV (SEQ ID NO: 873) | SYGMH (SEQ ID NO: 867) | GINWNGGSTGYADSVKG (SEQ ID NO: 868) | GHHSGYDGRFFDY (SEQ ID NO: 869) |
| TPP-27480 | VL: A10V, T13A; VH: G50A | TGSSSNIGAGYNVH (SEQ ID NO: 891) | TNNRRPS (SEQ ID NO: 892) | AAWDASLSGWV (SEQ ID NO: 893) | HYGMH (SEQ ID NO:8 87) | AINWNGGSTGYADSVKG (SEQ ID NO: 888) | GHHSGYDGRFFDY (SEQ ID NO: 889) |
| TPP-29367 | C-terminal K | TGSSSNIGAGYNVH (SEQ ID NO: 911) | TNNRRPS (SEQ ID NO: 912) | AAWDASLSGWV (SEQ ID NO: 913) | HYGMH (SEQ ID NO: 907) | GINWNGGSTGYADSVKG (SEQ ID NO: 908) | GHIHSGYDGRFFDY (SEQ ID NO: 909) |
| TPP-29368 | VL: A10V, T13A; C-terminal K | TGSSSNIGAGYNVH (SEQ ID NO: 931) | TNNRRPS (SEQ ID NO: 932) | AAWDASLSGWV (SEQ ID NO: 933) | HYGMH (SEQ ID NO: 927) | GINWNGGSTGYADSVKG (SEQ ID NO: 928) | GHIHSGYDGRFFDY (SEQ ID NO: 929) |

TABLE 7.2 b-continued

CDRs for anti-human CCR8 candidate antibodies derived from TPP-23411.

| Identifier | Mutation | LCDR1 | LCDR2 | LCDR3 | HCDR1 | HCDR2 | HCDR3 |
|---|---|---|---|---|---|---|---|
| TPP-29369 | VH: H31S, G50A; C-terminal K | TGSSSNIGAGYNVH (SEQ ID NO: 951) | TNNRRPS (SEQ ID NO: 952) | AAWDASLSGWV (SEQ ID NO: 953) | SYGMH (SEQ ID NO: 947) | AINWNGGSTGYADSVKG (SEQ ID NO: 948) | GHIHSGYDGRFFDY (SEQ ID NO: 949) |

TABLE 7.3

CDRs for specific anti-murine CCR8 candidate antibodies derived with a mixed approach.

| Identifier | LCDR1 | LCDR2 | LCDR3 | HCDR1 | HCDR2 | HCDR3 |
|---|---|---|---|---|---|---|
| TPP-14099 | SGSSFNIGSHFVY (SEQ ID NO: 220) | KNNQRPS (SEQ ID NO: 221) | AAWDDSLNGPV (SEQ ID NO: 222) | DYGVH (SEQ ID NO: 216) | GVSWNGSRTHYADSVKG (SEQ ID NO: 217) | RGA (SEQ ID NO: 218) |
| TPP-14095 | SGSSSNIGSNYVY (SEQ ID NO: 206) | GNNNRPS (SEQ ID NO: 207) | AAWDDSLNGWV (SEQ ID NO: 208) | SYGMH (SEQ ID NO: 202) | AISGSGGSTYYADSVKG (SEQ ID NO: 203) | GRQLGS (SEQ ID NO: 204) |
| TPP-15285 | SGSSFNIGSHFVY (SEQ ID NO: 234) | KNNQRPS (SEQ ID NO: 235) | AAWDDSLNGPV (SEQ ID NO: 236) | DYGVH (SEQ ID NO: 230) | GVSWNGSRTHYADSVKG (SEQ ID NO: 231) | RGA (SEQ ID NO: 232) |
| TPP-15286 | SGSSSNIGSNYVY (SEQ ID NO: 248) | GNNNRPS (SEQ ID NO: 249) | AAWDDSLNGWV (SEQ ID NO: 250) | SYGMH (SEQ ID NO: 244) | AISGSGGSTYYADSVKG (SEQ ID NO: 245) | GRQLGS (SEQ ID NO: 246) |

TABLE 8.1

List of peptides used for antibody selection by phage display and ELISA screening

| ID | Antigen | Species | Domain | Sulfation | Additional modifications |
|---|---|---|---|---|---|
| TPP-13792 | CCR8 | mouse | TRD (SEQ ID NO: 45) | no | N-terminal biotinylation via TTDS_Lysin linker |
| TPP-13793 | CCR8 | mouse | TRD (SEQ ID NO: 45) | Y3, Y14, Y15 | N-terminal biotinylation via TTDS_Lysin linker |
| TPP-13799 (off-target) | CCR4 | human | TRD (SEQ ID NO: 19) | no | N-terminal biotinylation via TTDS_Lysin linker |
| TPP-13800 | CCR4 | human | TRD (SEQ ID NO: 19) | Y19, Y22 | N-terminal biotinylation via TTDS_Lysin linker |

TABLE 9.1

Structural analysis of HCDR3 for specific human anti-human CCR8 candidate antibodies obtained a method according to the current invention.

| Identifier | HCDR3 | H | K | R | Y | D | E | %H | %K | %R | %Y | %D | %E | %(H+Y) | %Positive | %Negative | %Charged | Length |
|---|---|---|---|---|---|---|---|---|---|---|---|---|---|---|---|---|---|---|
| TPP-17575 (SEQ ID NO: 278) | GGIGRRPGLEY | 0,0 | 0,0 | 2,0 | 1,0 | 0,0 | 1,0 | 0,0 | 0,0 | 18,2 | 9,1 | 0,0 | 9,1 | 9,1 | 18,2 | 9,1 | 27,3 | 11,0 |
| TPP-17576 (SEQ ID NO: 296) | PLDS | 0,0 | 0,0 | 0,0 | 0,0 | 1,0 | 0,0 | 0,0 | 0,0 | 0,0 | 0,0 | 25,0 | 0,0 | 0,0 | 0,0 | 25,0 | 25,0 | 4,0 |
| TPP-17577 (SEQ ID NO: 314) | GLPYGY | 0,0 | 0,0 | 0,0 | 2,0 | 0,0 | 0,0 | 0,0 | 0,0 | 0,0 | 33,3 | 0,0 | 0,0 | 33,3 | 0,0 | 0,0 | 0,0 | 6,0 |
| TPP-17578 (SEQ ID NO: 332) | TYSGHYGPYFDN | 1,0 | 0,0 | 0,0 | 3,0 | 1,0 | 0,0 | 8,3 | 0,0 | 0,0 | 25,0 | 8,3 | 0,0 | 33,3 | 8,3 | 8,3 | 16,7 | 12,0 |
| TPP-17579 (SEQ ID NO: 350) | YSGYPDYYGMDV | 0,0 | 0,0 | 0,0 | 4,0 | 2,0 | 0,0 | 0,0 | 0,0 | 0,0 | 33,3 | 16,7 | 0,0 | 33,3 | 0,0 | 16,7 | 16,7 | 12,0 |
| TPP-17580 (SEQ ID NO: 368) | GSYNSGWYAVS | 0,0 | 0,0 | 0,0 | 2,0 | 0,0 | 0,0 | 0,0 | 0,0 | 0,0 | 18,2 | 0,0 | 0,0 | 18,2 | 0,0 | 0,0 | 0,0 | 11,0 |
| TPP-17581 (SEQ ID NO: 386) | GRFDTRGFYGFDY | 0,0 | 0,0 | 2,0 | 2,0 | 2,0 | 0,0 | 0,0 | 0,0 | 15,4 | 15,4 | 15,4 | 0,0 | 15,4 | 15,4 | 15,4 | 30,8 | 13,0 |
| TPP-18205 (SEQ ID NO: 404) | SGNYYVGYHGMDV | 1,0 | 0,0 | 0,0 | 3,0 | 1,0 | 0,0 | 7,7 | 0,0 | 0,0 | 23,1 | 7,7 | 0,0 | 30,8 | 7,7 | 7,7 | 15,4 | 13,0 |
| TPP-18206 (SEQ ID NO: 422) | GEIHSGYDGRFFDY | 2,0 | 0,0 | 1,0 | 2,0 | 2,0 | 0,0 | 15,4 | 0,0 | 7,7 | 15,4 | 15,4 | 0,0 | 30,8 | 23,1 | 15,4 | 38,5 | 13,0 |
| TPP-18207 (SEQ ID NO: 440) | TYTGNYGPYFDY | 0,0 | 0,0 | 0,0 | 4,0 | 1,0 | 0,0 | 0,0 | 0,0 | 0,0 | 33,3 | 8,3 | 0,0 | 33,3 | 0,0 | 8,3 | 8,3 | 12,0 |
| Average | | 0,4 | 0,0 | 0,5 | 2,3 | 1,0 | 0,1 | 3,1 | 0,0 | 4,1 | 20,6 | 9,7 | 0,9 | 23,8 | 7,3 | 10,6 | 17,9 | 10,7 |

TABLE 9.2

Structural analysis of HCDR3 for specific human anti-human CCR8 candidate antibodies with superior therapeutic profile, e.g. low internalization.

| Identifier | HCDR3 | H | K | R | Y | D | E | %H | %K | %R | %Y | %D | %E | %(H+Y) | %Positive | %Negative | %Charged | Length |
|---|---|---|---|---|---|---|---|---|---|---|---|---|---|---|---|---|---|---|
| TPP-16966 (SEQ ID NO: 260) | AAAGTRGFDY | 0,0 | 0,0 | 1,0 | 1,0 | 1,0 | 0,0 | 0,0 | 0,0 | 10,0 | 10,0 | 10,0 | 0,0 | 10,0 | 10,0 | 10,0 | 20,0 | 10,0 |
| TPP-17546 (SEQ ID NO: 458) | TYSGHYGPYFDY | 1,0 | 0,0 | 0,0 | 4,0 | 1,0 | 0,0 | 8,3 | 0,0 | 0,0 | 33,3 | 8,3 | 0,0 | 41,7 | 8,3 | 8,3 | 16,7 | 12,0 |
| TPP-17578 (SEQ ID NO: 332) | TYSGHYGPYFDN | 1,0 | 0,0 | 0,0 | 3,0 | 1,0 | 0,0 | 8,3 | 0,0 | 0,0 | 25,0 | 8,3 | 0,0 | 33,3 | 8,3 | 8,3 | 16,7 | 12,0 |
| TPP-18205 (SEQ ID NO: 404) | SGNYYVGYHGMDV | 1,0 | 0,0 | 0,0 | 3,0 | 1,0 | 0,0 | 7,7 | 0,0 | 0,0 | 23,1 | 7,7 | 0,0 | 30,8 | 7,7 | 7,7 | 15,4 | 13,0 |
| TPP-18206 (SEQ ID NO: 422) | GEIHSGYDGRFFDY | 2,0 | 0,0 | 1,0 | 2,0 | 2,0 | 0,0 | 15,4 | 0,0 | 7,7 | 15,4 | 15,4 | 0,0 | 30,8 | 23,1 | 15,4 | 38,5 | 13,0 |
| TPP-19546 (SEQ ID NO: 458) | TYSGHYGPYFDY | 1,0 | 0,0 | 0,0 | 4,0 | 1,0 | 0,0 | 8,3 | 0,0 | 0,0 | 33,3 | 8,3 | 0,0 | 41,7 | 8,3 | 8,3 | 16,7 | 12,0 |

TABLE 9.2-continued

Structural analysis of HCDR3 for specific human anti-human CCR8 candidate antibodies with superior therapeutic profile, e.g. low internalization.

| Identifier | HCDR3 | H | K | R | Y | D | E | %H | %K | %R | %Y | %D | %E | %(H+Y) | %Positive | %Negative | %Charged | Length |
|---|---|---|---|---|---|---|---|---|---|---|---|---|---|---|---|---|---|---|
| TPP-20950 | GEIHSGKDGRFFDY (SEQ ID NO: 476) | 2,0 | 1,0 | 1,0 | 1,0 | 2,0 | 0,0 | 15,4 | 7,7 | 7,7 | 7,7 | 15,4 | 0,0 | 23,1 | 30,8 | 15,4 | 46,2 | 13,0 |
| TPP-20955 | GEIHKGYDGRFFDY (SEQ ID NO: 494) | 2,0 | 1,0 | 1,0 | 2,0 | 2,0 | 0,0 | 15,4 | 7,7 | 7,7 | 15,4 | 15,4 | 0,0 | 30,8 | 30,8 | 15,4 | 46,2 | 13,0 |
| TPP-20965 | GEIHSGKDGRFFDY (SEQ ID NO: 512) | 2,0 | 1,0 | 1,0 | 1,0 | 2,0 | 0,0 | 15,4 | 7,7 | 7,7 | 7,7 | 15,4 | 0,0 | 23,1 | 30,8 | 15,4 | 46,2 | 13,0 |
| TPP-21045 | TYSGHYGPFFDY (SEQ ID NO: 530) | 1,0 | 0,0 | 0,0 | 3,0 | 1,0 | 0,0 | 8,3 | 0,0 | 0,0 | 25,0 | 8,3 | 0,0 | 33,3 | 8,3 | 8,3 | 16,7 | 12,0 |
| TPP-21047 | TYSGHYGPYFDY (SEQ ID NO: 548) | 1,0 | 0,0 | 0,0 | 4,0 | 1,0 | 0,0 | 8,3 | 0,0 | 0,0 | 33,3 | 8,3 | 0,0 | 41,7 | 8,3 | 8,3 | 16,7 | 12,0 |
| TPP-21181 | SGNYYYGYHGMDV (SEQ ID NO: 566) | 1,0 | 0,0 | 0,0 | 4,0 | 1,0 | 0,0 | 7,7 | 0,0 | 0,0 | 30,8 | 7,7 | 0,0 | 38,5 | 7,7 | 7,7 | 15,4 | 13,0 |
| TPP-21183 | SGNEYYGYHGMDV (SEQ ID NO: 584) | 1,0 | 0,0 | 0,0 | 3,0 | 1,0 | 1,0 | 7,7 | 0,0 | 0,0 | 23,1 | 7,7 | 7,7 | 30,8 | 7,7 | 15,4 | 23,1 | 13,0 |
| TPP-23411 | GEIHSGYDGRFFDY (SEQ ID NO: 620) | 2,0 | 0,0 | 1,0 | 2,0 | 2,0 | 0,0 | 15,4 | 0,0 | 7,7 | 15,4 | 15,4 | 0,0 | 30,8 | 23,1 | 15,4 | 38,5 | 13,0 |
| Average | | 1,3 | 0,2 | 0,4 | 2,6 | 1,4 | 0,1 | 10,1 | 1,6 | 3,5 | 21,3 | 10,8 | 0,5 | 31,4 | 15,2 | 11,4 | 26,6 | 12,4 |

For the generation of antibodies binding mouse CCR8, a selection strategy was designed to identify antibodies exhibiting binding activity towards the mouse CCR8 tyrosine rich domain (TRD) within the N-terminal region. For positive selection on the mouse CCR8 TRD peptides, a mixture containing 50% normal peptide and 50% sulfated peptide was used (Seq ID NO:45 non-sulfated (TPP-13792) or with Y3, Y14, Y15 being sulfated (TPP-13793)). A depletion step was included using a biotinylated off-target peptide being the human CCR4 TRD within the N-terminal region. Also, the depletion step on human CCR4 was conducted on a mixture of sulfated and non-sulfated peptide (Seq ID No: 19 non-sulfated (TPP-13799) or with Y19 and Y22 being sulfated (TPP-13800)).

Figures 5, 6:
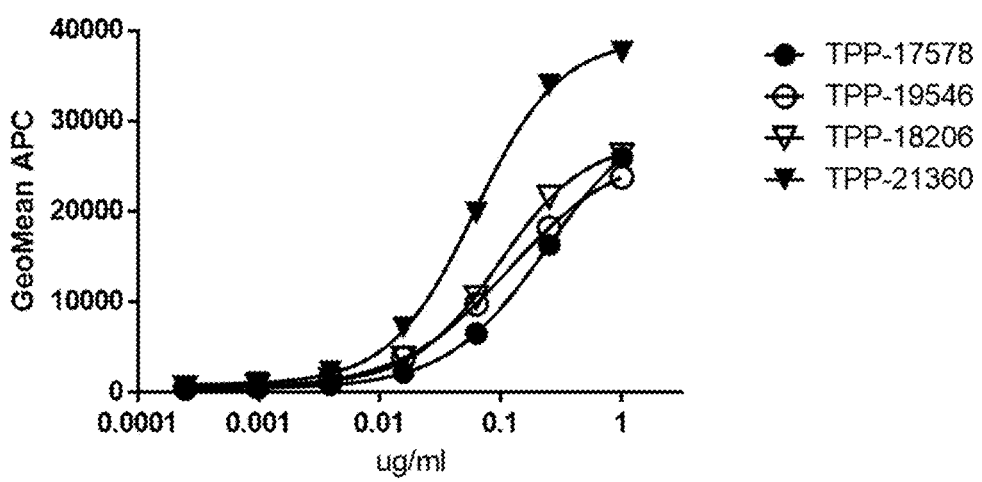
FIG. 5: Panning strategy to obtain anti-murine CCR8 antibodies: The main strategy for selection based on a mix of sulfated/non-sulfated peptides is depicted. Prior to each round of selection, a depletion step on a relevant biotinylated protein was performed.
FIG. 6: FACS data of inventive antibodies binding to CHO cells expressing human CCR8.

The panning strategy was to conduct four panning rounds in total, each on the specified mixture of sulfated and non-sulfated peptides, see FIG. 5.

For each clone pool monoclonal cultivation and expression of 88 randomly picked Fab-phage clones was performed and clones were subsequently tested for binding to the respective target used before for panning. However, separate ELISA measurements were conducted for the sulfated and the non-sulfated peptides.

In addition, binding to cells expressing human, mouse and cynomolgus CCR8 was determined by flow cytometry (FACS).

A specific binder is defined in the particular context as a molecule showing
(i) in the ELISA assay a signal intensity for the target which is at least 10 times higher than signal intensity for the off-target, and
(ii) in FACS assay a signal for the CCR8 expressing cell lines which is at least 10 times higher than the signal for a control cell line not expressing CCR8.

Within these measurements, the antibodies TPP-14095 and TPP-14099 were identified demonstrating binding to mouse CCR8 expressing cells but no binding to control cells, control cells expressing human CCR8, or control cells expressing cynomolgus CCR8. Further, the antibodies were found to bind to the sulfated TRD peptide but not to the non-sulfated peptide.

Example 9: Structural Characterization of the CCR8 Antibodies

Out of the six CDR loops, the H3 loop shows the greatest structural diversity and is located in the center of the binding site. It also gains the most mutations through affinity maturation and has on average the largest number of contacts with the antigen. It therefore plays a crucial role in antigen binding. Upon analysis of the specific structure of the antibodies obtained in the previous examples, it was surprisingly found that the composition of the HCDR3 was structurally different from usual human HCDR3 domains. In more detail, the HCDR3 domain of the human anti-human CCR8 antibodies had a substantially higher number of tyrosine residues (~20% for the initial set of specific human CCR8 binders, ~21% for the optimized candidates) than would be expected for a random fully human HCDR3 with matched length (~10%, cf. Zemlin, Michael, et al. "Expressed murine and human HCDR3 intervals of equal length exhibit distinct repertoires that differ in their amino acid composition and predicted range of structures." Journal of molecular biology 334.4 (2003): 733-749.).

These data suggest a beneficial impact of tyrosine presence for specific binding to the sulfated antigen. The optimized antibodies were furthermore characterized by a substantial increase in histidine frequency. For these antibodies, the histidine content was on average 10%. The average occurrence of histidine in HCDR3 of a matched length is approximately 2% in murine HCDR3 and even lower in human HCDR3, cf. Zemlin, Michael, et al. (2003).

Because the antigens used for selection are characterized by negative charges provided in the form of sulfated tyrosines and negatively charged amino acids, the inventors hypothesized that the occurrence of positive charges in HCDR3 improves the binding to the sulfated antigen but is less essential for binding to the non-sulfated antigen. While the frequency of positively charged residues (H, K, R) in the HCDR3s of the initially obtained set of antibodies was approximately 7%, the improved antibodies had on average 15% of positive amino acids per HCDR3 (e.g. up to ~31%).

The antibodies according to the current invention are characterized by a tyrosine frequency which is higher than for usual fully human HCDR3s. While these high tyrosine frequencies are more easily obtained with murine CDRs this may explain why previous attempts to obtain human anti-human antibodies specifically recognizing CC chemokine receptors such as CCR8 have not been successful.

Example 10: Functional Characterization of the Anti-CCR8 Antibodies

Cell Lines

Stable HEK 293 and CHO cell lines expressing human, cynomolgus or murine CCR8 were generated using Inscreenex, as known in the art. Thymoma cell lines Hut-78 and lymphoma cell line TALL-1 were obtained from ATCC and were confirmed to show endogenous CCR8 expression. Because CCR8 expression may vary, expression levels were monitored.

Human T Regulatory Cells

FACS sorted CD4+ and CD25+ cells from PBMCs of healthy donors were purchased from either BioIVT, All-Cells, or StemCell Technologies. After thawing the cells and recovery in culture overnight, the cells were activated with anti-CD3 and anti-CD28 beads designed for Treg expansion from Miltenyi and supplemented with IL-2 (R&D Systems) as directed by the Treg expansion kit protocol. Typically, after activation of naïve PBMCs, CCR8 expression was the highest between day 5-7, and cells can be restimulated 7-9 days after primary activation. Upon restimulation, CCR8 expression was the highest between day 2-4.

Example 10.1.1: Evaluation of Affinities for Binding CCR8 from Different Species FACS Experiments The affinity of the antibodies for human, cynomolgus and murine CCR8 and further chemokine receptors was determined by FACS as known in the art. In brief, CHO cells were engineered to express the CCR8 from the respective species. In the alternative, activated human Tregs from a human donor were used to determine the affinity of the antibodies for activated Tregs. EC50 values were determined by FACS. All candidate antibodies had not only a superior affinity for human CCR8 with an EC50 in the low digit nanomolar range, but also a superior affinity for cynomolgus CCR8 in the same order of magnitude. Similar affinities in these species are important to facilitate studies for prediction of later safety issues in humans. This is a major issue in the search for therapeutic antibodies in immune oncology, because mouse models have major limitations in the prediction of immunological side effects in humans. The EC50 determined for binding human Tregs were between 10 and 25 nM for the inventive antibodies shown in Table 10.1.1.1

Affinities of inventive antibodies in CHO cells expressing human CCR8, CHO cells expressing cynomolgus CCR8, or activated human Tregs (donor 1) are shown in FIGS. 6, 7 and 8, respectively.

TABLE 10.1.1.1

EC50 values of inventive antibodies in nM. FACS staining was performed on CHO cells stably expressing either human CCR8 or cynomolgus CCR8, or on human activated CD4+CD25+ T cells. These cells were activated with the Treg expansion kit from Miltenyi.

|  | TPP-17578 | TPP-19546 | TPP-18206 | TPP-21360 |
|---|---|---|---|---|
| CHO with hCCR8: EC50 in nM | 1.66 | 0.78 | 0.64 | 0.40 |
| CHO with cynoCCR8: EC50 in nM | 1.04 | 0.52 | 0.67 | 0.34 |
| human Treg: EC50 in nM | 25.12 | 15.25 | 23.1 | 10.35 |

Antibodies TPP-23411 and TPP-21360 deviate from each other by one lysine residue added at the C-term of the heavy chain, i.e. TPP-23411 comprises the lysine. TPP-23411 and TPP-21360 were tested in a separate FACS experiment for binding to human and cynomolgus CCR8. The EC50 curves for binding of human CCR8 as well as cynomolgus CCR8 were perfectly aligned between the two antibodies (data not shown, cf. Table 10.1.1.2 for IC50 values).

TABLE 10.1.1.2

EC50 values of candidates measured in nM. Staining was performed on CHO cells stably expressing either human CCR8 or cynomolgus CCR8.

|  | TPP-21360 | TPP-23411 |
|---|---|---|
| CHO with hCCR8: EC50 in nM | 1.4 | 1.7 |
| CHO with cynoCCR8: EC50 in nM | 0.8 | 0.9 |

TPP-21181 and TPP-23411 were tested in a separate FACS experiment for binding to human and cynomolgus CCR8, cf. FIG. 9, 10. Respective EC50 values are listed in Table 10.1.1.3.

TABLE 10.1.1.3

EC50 values of antibodies measured in nM. Staining was performed on CHO cells stably expressing either human CCR8 or cynomolgus CCR8.

|  | TPP-21181 | TPP-23411 |
|---|---|---|
| CHO with hCCR8: EC50 in nM | 4.8 | 4.4 |
| CHO with cynoCCR8: EC50 in nM | 1.8 | 1.3 |

In a further FACS experiment, prior art antibodies L263G8 (Biolegend) and 433H (ICOS, BD) were compared to TPP-21360 with regards to binding to human and cynomolgus CCR8, cf. FIG. 11, 12 and Table 10.1.1.4. Prior art antibodies showed only low or substantially no overall binding to cynomolgus CCR8 (low saturation, here MFI<<1000). Only the antibodies according to the current invention specifically recognized human and cynomolgus CCR8 with affinities in the same order of magnitude, i.e. in some cases even in the sub nanomolar range.

TABLE 10.1.1.4

EC50 values of TPP-21360 compared to L263G8 and 433H. Staining was performed on CHO cells stably expressing either human CCR8 or cynomolgus CCR8.

|  | TPP-21360 | L263G8 | 433H |
|---|---|---|---|
| CHO with hCCR8: EC50 in nM | 0.58 | 0.31 | 2.8 |
| CHO with cynoCCR8: EC50 in nM | 0.51 | 132 | 12.1 |

Figure 13:
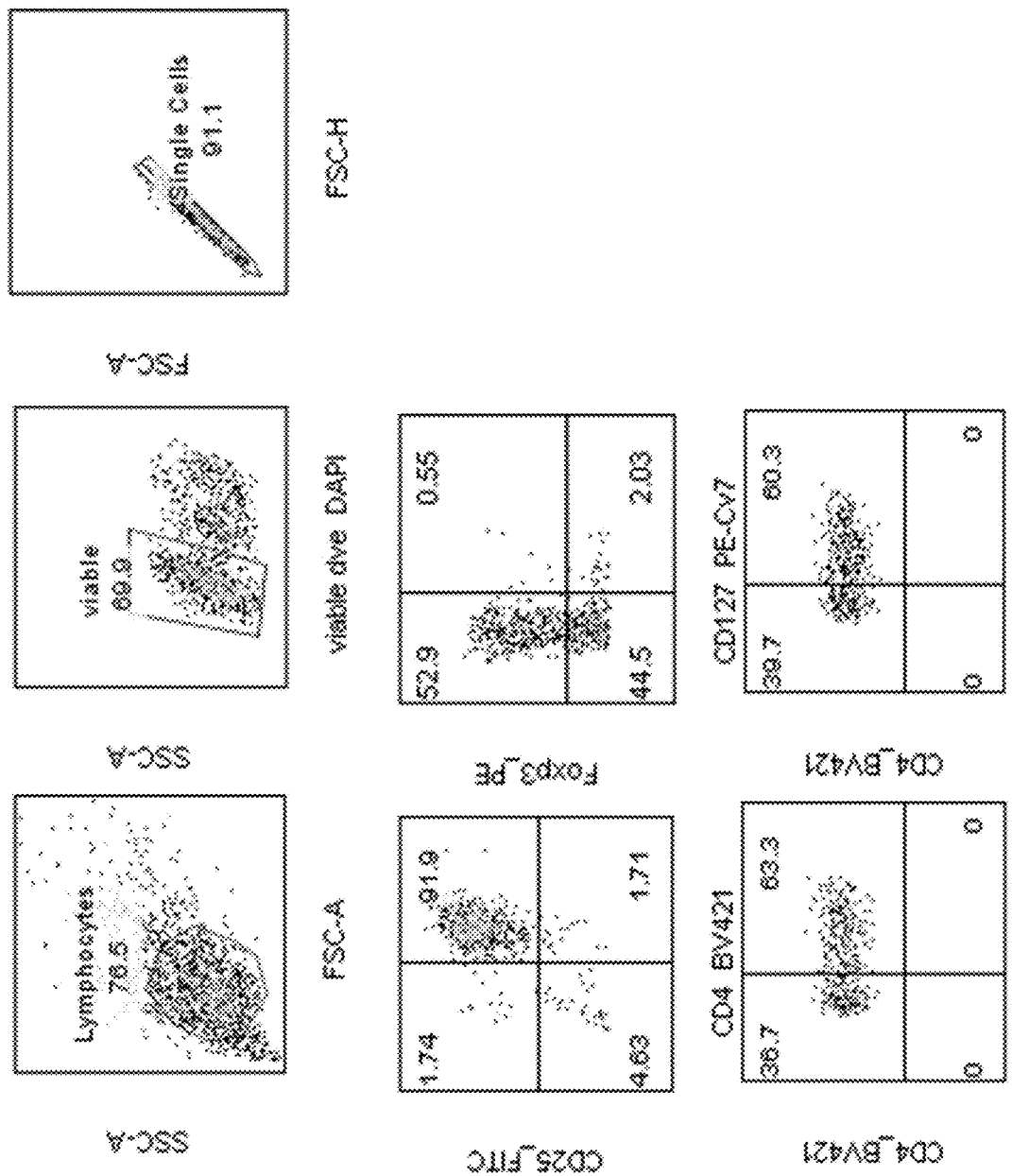
FIG. 13: Activated human Treg staining with inventive antibody TPP-23411, gating strategy. CD4+ and CD25+ sorted cells from peripheral blood mononuclear cells (PBMC) were activated with anti-CD3 and anti-CD28 beads (Treg expansion kit, Miltenyi). Middle pane: Cells that are CD4+CD25+CD127low and Foxp3+. Lower panel: CCR8 expression on Tregs after staining with TPP-23411 or L263G8.

These results show that the use of the sulfated antigen facilitates the generation of cross-reactive antibodies such as cynomolgus/human for difficult targets such as CCR8, which are specific for their intended target. As a proof of concept, activated human Tregs were stained with inventive antibody TPP-23411 or prior art antibody L263G8, as shown in FIG. 13. The inventive antibodies which recognize murine CCR8 have likewise excellent affinities for their target, as shown in Table 10.1.1.5.

TABLE 10.1.1.5

EC50 values of TPP-14095 and TPP-14099. FACS staining was performed on CHO cells expressing murine CCR8.

|  | TPP-14095 | TPP-14099 |
|---|---|---|
| EC50 in nM | 0.7 | 3 |

Table 10.1.1.6 shows EC50 values for binding of various further inventive anti-human CCR8 antibodies to CHO cells transfected with human CCR8 or cynomolgus CCR8, or to Hut78 cells expressing endogenous human CCR8. Interestingly, antibodies having a G50M mutation had a higher binding affinity to CHO cells expressing cynomolgus CCR8. Anti-CCR8 antibodies comprising this framework mutation are therefore preferred.

TABLE 10.1.1.6

EC50 values in M characterizing the binding of inventive anti-human CCR8 antibodies to CHO cells transfected with human CCR8 or cynomolgus CCR8, as described elsewhere herein, or to cell line HuT78, which endogenously expresses human CCR8.

| Antibody | hCCR8:CHO EC50 [M] | cynoCCR8:CHO EC50 [M] | HuT78 EC50 [M] |
|---|---|---|---|
| TPP-17577 | 1.11E−08 | 9.81E−09 |  |
| TPP-17578 | 1.15E−08 | 2.72E−09 | 1.78E−07 |
| TPP-18205 | 8.33E−09 | 8.59E−08 | 1.41E−07 |
| TPP-18206 | 2.63E−09 | 2.23E−09 | 4.70E−08 |
| TPP-20955 | 4.69E−10 | 4.75E−10 | 4.56E−10 |
| TPP-21047 | 2.56E−09 | 3.77E−10 | 5.02E−09 |
| TPP-23411 | 1.38E−09 | 7.76E−10 | 2.78E−09 |
| TPP-27495 | 1.32E−09 | 5.35E−10 | 3.25E−09 |
| TPP-27496 | 1.51E−09 | 4.55E−10 | 3.68E−09 |
| TPP-18429 | 1.48E−09 | 2.25E−09 | 2.93E−08 |
| TPP-18430 | 1.69E−09 | 1.37E−09 | 5.24E−08 |
| TPP-18432 | 2.21E−09 | 3.33E−09 | 1.91E−08 |
| TPP-18433 | 1.48E−09 | 1.92E−09 | 3.30E−08 |
| TPP-18436 | 1.12E−09 | 4.42E−10 | 3.76E−09 |
| TPP-19571 | 1.48E−09 | 8.79E−10 | 1.49E−09 |
| TPP-27478 | 2.74E−09 | 1.02E−09 |  |
| TPP-27477 | 1.01E−09 | 4.18E−10 | 2.10E−09 |
| TPP-27479 | 2.22E−09 | 5.88E−09 | 1.31E−08 |
| TPP-27480 | 1.14E−09 | 7.70E−10 | 4.71E−09 |

Example 10.1.2: SPR Experiments for Characterization of Binding Affinities of Antibodies for Unmodified TRD Domains of Different Species To analyze the affinity of the antibodies for their unmodified (i.e. non-sulfated) antigen, surface plasmon resonance (SPR) binding assays were performed on a Biacore T200 instrument at 25° C. with assay buffer HBS-EP+1×, 1 mg/ml BSA, 300 mM NaCl. IgGs were captured using anti-human Fc IgGs covalently amine coupled to a CM5 sensor chip. N terminally His6-tagged human CCR8 TRD (TPP-19950: MDYTLDLSVTTVTDYYYPDIFSSP, SEQ ID NO:43), cynomolgus CCR8 TRD (TPP-19952: MDYTLDPSMTTMTDYYYPDSLSSP, SEQ ID NO:44) or murine CCR8 TRD (TPP-19951: MDYT-MEPNVTMTDYYPDFFTAP, SEQ ID NO:45) was C-terminally fused with human serum albumin (HSA) to generate the CCR8-HSA fusion proteins. The respective CCR8-HSA fusion protein was used as analyte with a concentration range of 1.56-200 nM in multicycle kinetics mode. Obtained sensorgrams were fitted to a 1:1 Langmuir binding model. For human anti-human CCR8 antibodies TPP-23411 and TPP-21360, binding was low (160 nM) and binding to cynomolgus CCR8 TRD was even lower, e.g. in the µM range, supporting the importance of sulfation for the antibody recognition for the inventive antibodies.

Table 10.1.2.1: Binding affinities of inventive antibodies for the His6-tagged HSA-fused TRD of human, cynomolgus or murine CCR8 determined by SPR. Binding to cynomolgus CCR8 peptide is in the µM range and is an approximation as the highest concentration tested was 200 nM. HSA alone and isotype controls did not show any binding (data not shown).

TABLE 10.1.2.1

Binding affinities of inventive antibodies for the His6-tagged HSA-fused TRD of human, cynomolgus or murine CCR8 determined by SPR. Binding to cynomolgus CCR8 peptide is in the µM range and is an approximation as the highest concentration tested was 200 nM. HSA alone and isotype controls did not show any binding (data not shown).

| Ligand | Analyte | $k_a$ [1/Ms] | $k_d$ [1/s] | $K_D$ [M] |
|---|---|---|---|---|
| TPP-21360 | cyno | 3.5E+04 | 1.3E−01 | 3.8E−06 |
|  | human | 1.2E+05 | 1.8E−02 | 1.6E−07 |
|  | mouse |  | no binding |  |
| TPP-14099 | cyno |  | no binding |  |
|  | human |  | no binding |  |
|  | mouse | 2.2E+03 | 1.1E−03 | 5.2E−07 |
| TPP-23411 | cyno | 6.2E+03 | 1.2E−01 | 2.0E−05 |
|  | human | 1.1E+05 | 1.7E−02 | 1.6E−07 |
|  | mouse |  | no binding |  |

Example 10.1.3: SPR Experiments for Systematic Characterization of Binding Affinities SPR binding assays were performed to systematically evaluate antibody binding to a) non-sulfated vs sulfated antigen, b) TRD vs N term and c) human vs cynomolgus CCR8. SPR binding assays were performed on a Biacore T200 instrument (Cytiva) at 25° C. with assay buffer 1x HBS-EP+(order no. BR100826, Cytiva). Peptides were used as ligands and were captured using their C-terminal biotin label on to a streptavidin coated sensor chip ("Sensor Chip SA", Order No. BR100398, Cytiva). To this end, a terminal lysine (K) was added at the C-term of each peptide for biotinylation. For the N term of CCR8, the naturally occurring cysteine between TRD and LID domain was replaced by a serine. Antibodies were used as analytes (TPP-19546, TPP-21181, TPP-23411, hIgG1 isotype control TPP-9809 and mIgG2a isotype control TPP-10748). The concentration of analyte in assay buffer was 0.05-10 nM and the measurement was performed in multicycle kinetics mode. The sensor surface was regenerated with glycine pH 2.0 after each cycle. Obtained sensorgrams were double referenced (subtraction of reference flow cell signal and buffer injection) and were fitted to a 1:1 Langmuir binding model to derive kinetic data using the Biacore T200 Evaluation software.

Table 10.1.3.1: List of peptides used to characterize the epitope of the antibodies. Peptides comprising the TRD sequence (#1 to 4) or N term (#5 to 8) of CCR8, derived from cynomolgus (#1, 2, 5, 6) or human (#3, 4, 7, 8) CCR8, either sulfated (#2, 4, 6, 8) or non-sulfated (#1, 3, 5, 7). SO3: sulfate residue. Biot: biotin modification for immobilization.

TABLE 10.1.3.1

List of peptides used to characterize the epitope of the antibodies. Peptides comprising the TRD sequence (# 1 to 4) or N term (# 5 to 8) of CCR8, derived from cynomolgus (# 1, 2, 5, 6) or human (# 3, 4, 7, 8) CCR8, either sulfated (# 2, 4, 6, 8) or non-sulfated (# 1, 3, 5, 7). SO3: sulfate residue. Biot: biotin modification for immobilization.

| # | Type | Peptide Sequence |
|---|------|------------------|
| 1 | Cyno_TRD | H-CMDYTLDPSMTTMTDYYYPDSLSSPK(Biot)-OH (SEQ ID NO: 966) |
| 2 | Cyno_TRD_Ys | H-CMDY(SO3)TLDPSMTTMTDY(SO3)YY(SO3)PDSLSSPK(Biot)-OH (SEQ ID NO: 967) |
| 3 | HUMAN_TRD | H-CMDYTLDLSVTTVTDYYYPDIFSSPK(Biot)-OH (SEQ ID NO: 968) |
| 4 | HUMAN_TRD_Ys | H-CMDY(SO3)TLDLSVTTVTDY(SO3)YY(SO3)PDIFSSPK(Biot)-OH (SEQ ID NO: 969) |
| 5 | Cyno_NTerm | H-CMDYTLDPSMTTMTDYYYPDSLSSPSDGELIQRNDKK(Biot)-OH (SEQ ID NO: 970) |
| 6 | Cyno_NTerm_Ys | H-CMDY(SO3)TLDPSMTTMTDY(SO3)YY(SO3)PDSLSSPSDGELIQRNDKK(Biot)-OH (SEQ ID NO: 971) |
| 7 | HUMAN_NTerm | H-CMDYTLDLSVTTVTDYYYPDIFSSPSDAELIQTNGKK(Biot)-OH (SEQ ID NO: 972) |
| 8 | HUMAN_NTerm_Ys | H-CMDY(SO3)TLDLSVTTVTDY(SO3)YY(SO3)PDIFSSPSDAELIQTNGKK(Biot)-OH (SEQ ID NO: 973) |

For the analyzed inventive antibodies TPP-19546, TPP-21181, and TPP-23411, no binding to the non-sulfated TRD or non-sulfated N term of CCR8 was detected, independent of the species. In contrast, excellent affinities with $K_D$ values in the pM range were determined for sulfated TRD and sulfated N-term, e.g. of cynomolgus and/or human CCR8. In some cases, the $K_D$ value for binding to the TRD and to the N term of human CCR8 was substantially the same, i.e. within the error margin. In other cases, the binding to the N term was slightly improved.

In summary, these results demonstrate that sulfated tyrosine is causal for the binding. They furthermore suggest, that the sulfated TRD is necessary and sufficient for binding, but that the presence of the complete N term as epitope may in some cases further improve the binding. Finally, these results also demonstrate the cross-reactivity for human and cynomolgus CCR8.

TABLE 10.1.2.3

SPR binding affinities of inventive antibodies for the TRD or N term of cynomolgus or human CCR8. Peptides with odd numbers are characterized by unmodified tyrosines, peptides with even numbers are characterized by sulfated tyrosines (Ys). Isotype controls did not show binding to any of the peptides (data not shown). 1) mp = multiphasic: approximated values.

| Peptide | # | Antibody | $k_a$ (1/Ms) | $k_d$ (1/s) | $K_D$ (M) | $R_{Max}$ (RU) | Ligand Level (RU) | Activity in % | 1) |
|---------|---|----------|--------------|-------------|-----------|----------------|-------------------|---------------|-----|
| Cyno_TRD | 1 | IgG01_ | | no binding | | | 12 | | |
| Cyno_TRD_Ys | 2 | TPP- | 4.92E+06 | 8.44E-04 | 1.71E-10 | 46 | 12.4 | 81.8 | mp |
| HUMAN_TRD | 3 | 19546 | | no binding | | | 17 | | |
| HUMAN_TRD_Ys | 4 | | 6.69E+06 | 1.62E-03 | 2.42E-10 | 36 | 14.5 | 54.8 | mp |
| Cyno_NTerm | 5 | | | no binding | | | 27 | | |
| Cyno_NTerm_Ys | 6 | | 1.67E+07 | 1.54E-03 | 9.22E-11 | 58 | 12 | 106.9 | mp |
| HUMAN_NTerm | 7 | | | no binding | | | 14 | | |
| HUMAN_NTerm_Ys | 8 | | 2.61E+07 | 4.19E-03 | 1.60E-10 | 24 | 21 | 25.2 | mp |
| Cyno_TRD | 1 | IgG02_ | | no binding | | | 12 | | |
| Cyno_TRD_Ys | 2 | TPP- | 4.23E+09 | 5.87E+00 | 1.39E-09 | 30 | 12.4 | 52.9 | mp |
| HUMAN_TRD | 3 | 21181 | | no binding | | | 17 | | |
| HUMAN_TRD_Ys | 4 | | 5.56E+09 | 1.60E+01 | 2.87E-09 | 16 | 14.5 | 23.8 | mp |
| Cyno_NTerm | 5 | | | no binding | | | 27 | | |
| Cyno_NTerm_Ys | 6 | | 1.23E+10 | 1.07E+01 | 8.68E-10 | 43 | 12 | 78.5 | mp |
| HUMAN_NTerm | 7 | | | no binding | | | 14 | | |
| HUMAN_NTerm_Ys | 8 | | 7.69E+06 | 2.22E-02 | 2.88E-09 | 16 | 21 | 17.0 | mp |
| Cyno_TRD | 1 | IgG03_ | | no binding | | | 12 | | |
| Cyno_TRD_Ys | 2 | TPP- | 4.38E+06 | 4.54E-04 | 1.04E-10 | 46 | 12.4 | 82.1 | mp |
| HUMAN_TRD | 3 | 23411 | | no binding | | | 17 | | |
| HUMAN_TRD_Ys | 4 | | 2.86E+06 | 4.40E-04 | 1.54E-10 | 47 | 14.5 | 71.0 | mp |
| Cyno_NTerm | 5 | | | no binding | | | 27 | | |
| Cyno_NTerm_Ys | 6 | | 8.21E+06 | 4.64E-04 | 5.65E-11 | 62 | 12 | 112.9 | mp |
| HUMAN_NTerm | 7 | | | no binding | | | 14 | | |
| HUMAN_NTerm_Ys | 8 | | 9.19E+06 | 8.05E-04 | 8.76E-11 | 32 | 21 | 33.6 | mp |

Example 10.2: Specificity of Binding

Figure 14:
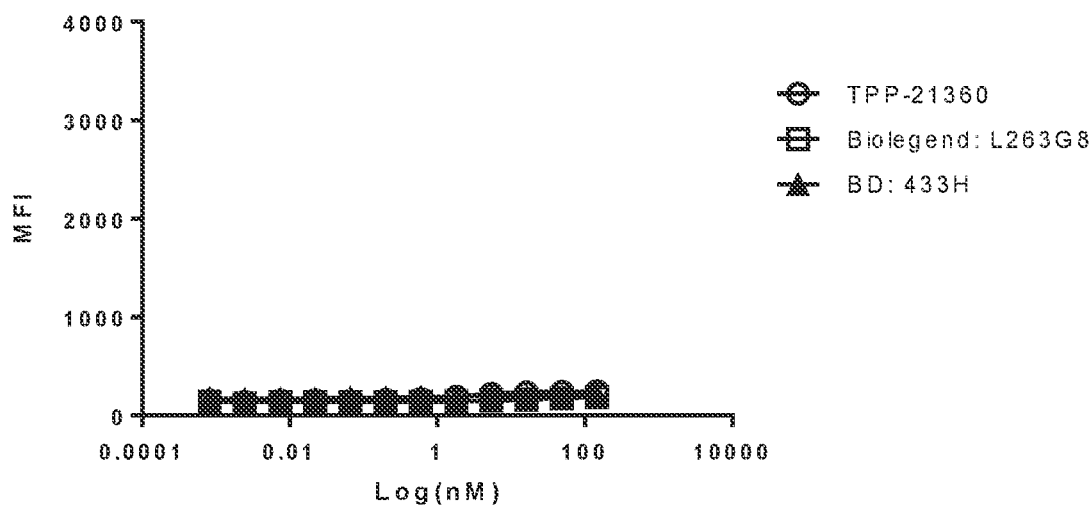
FIG. 14: Binding of TPP-21360 to CHO cells with mock transfectants. No unspecific binding was observed.

FACS analysis was performed as described elsewhere herein to determine unspecific binding to target negative human cell lines. No unspecific binding of anti-human CCR8 antibody TPP-23160 was observed for CHO cells with mock transfectants (FIG. 14).

Figure 15:
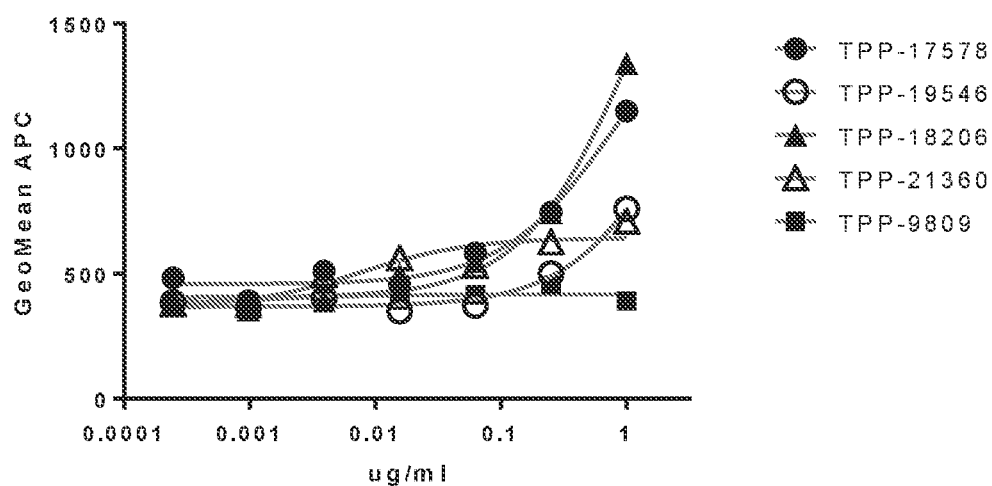
FIG. 15: Off target binding in HEK cells transiently transfected with human CCR1. Most inventive candidates showed only low off target binding for CCR1.
Figure 16:
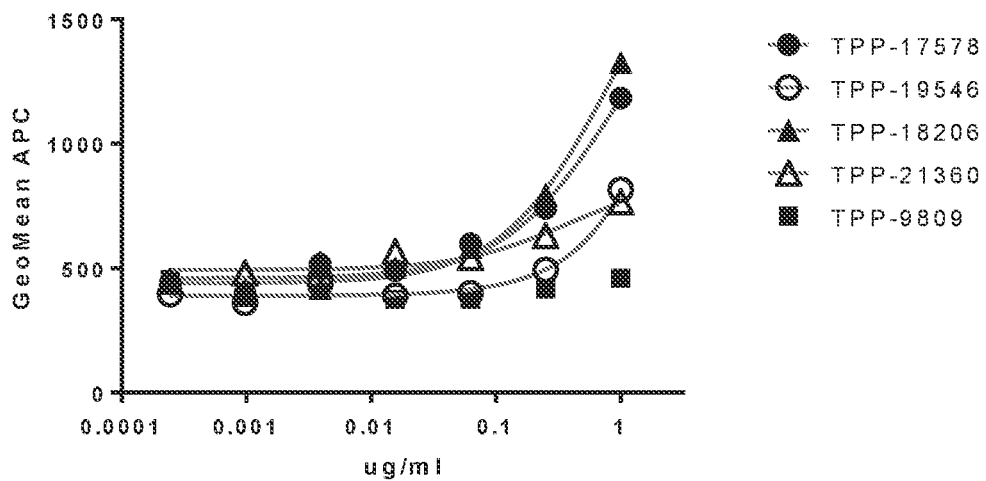
FIG. 16: Off target binding in HEK cells transiently transfected with human CCR4. Most inventive candidates showed only low off target binding for CCR4.

In addition, HEK cells were transiently transfected with human CCR1 or human CCR4. Off target binding was low for most of the inventive antibodies (FIG. 15, 16).

A cell panel with cell lines from different tumor tissues was used to characterize unspecific binding in these tissues (Table 10.2.1). The overall profile was favorable for most antibodies, while a certain degree of polyreactivity could be observed for some antibodies. Overall, the degree of polyreactivity was in an acceptable range for therapeutic applications for all inventive antibodies. However, TPP-20950, TPP-18206, TPP-18429, TPP-18430, and TPP-18433 showed a higher degree of polyreactivity and showed a certain degree of binding in at least two or three out of the seven cell lines shown below.

A second ELISA based experiment was performed to analyze unspecific binding to BVP, insulin or DNA for antibodies TPP-18206 (wt or afuco), TPP-21360 afuco, TPP-23411 (wt or afuco), TPP-20955, TPP-21047, and references TPP-9809 (isotype control), Gantenerumab (TPP-12151), Lenzilumab (TPP-12166), Remicade (TPP-12160) and Avastin (TPP-17586). Unspecific binding of the tested inventive antibodies to insulin, DNA as well as BVP was lower than unspecific binding of the first reference antibody (Gantenerumab, Roche). TPP-20955 and TPP-21047 showed overall more unspecific binding than the other inventive antibodies (data not shown). Overall, the degree of polyreactivity was in an acceptable range for therapeutic applications for all inventive antibodies, independent of their afucosylation status.

A third ELISA based experiment was performed to analyze unspecific binding to BVP, insulin or DNA for anti-

TABLE 10.2.1

Polyreactivity of inventive antibodies in a cell panel. If applicable, EC50 is shown in M.

| Antibody | Liver HepG2 | Liver SKHep1 | Kidney 786-O | Kidney A498 | Lung H292 | Colon HT29 | Burkitt lymphoma Raji |
|---|---|---|---|---|---|---|---|
| TPP-19546 | none | none | none | none | none | none | |
| TPP-20950 | none | none | none | 8.35E−07 | 7.59E−07 | none | |
| TPP-20955 | none | none | none | none | none | none | |
| TPP-21045 | 1.48E−07 | none | none | none | none | none | |
| TPP-21360 | none | none | none | none | none | none | |
| TPP-5657 (Isotype) | none | none | none | none | none | none | |
| TPP-17577 | none | none | none | none | none | none | none |
| TPP-17578 | none | none | none | none | none | none | none |
| TPP-18205 | none | none | none | none | binding | none | none |
| TPP-18206 | binding | binding | binding | none | none | none | none |
| TPP-20955 | none | none | none | none | none | none | none |
| TPP-21047 | none | none | none | none | none | none | none |
| TPP-23411 | none | none | none | none | none | none | none |
| TPP-27478 | none | none | none | none | none | none | none |
| TPP-27479 | none | none | none | none | none | none | none |
| TPP-27480 | none | none | none | none | none | none | none |
| TPP-27477 | none | none | none | none | none | none | none |
| TPP-27477 | none | none | none | none | none | none | none |
| TPP-27460 | none | none | none | none | none | none | none |
| TPP-27461 | none | none | none | none | none | none | none |
| TPP-27496 | none | none | none | none | none | none | none |
| TPP-27495 | none | none | none | none | none | none | none |
| TPP-18429 | binding | binding | binding | none | none | none | none |
| TPP-18430 | binding | binding | none | none | none | none | none |
| TPP-18432 | none | none | none | none | none | none | none |
| TPP-18433 | binding | binding | none | none | none | none | none |
| TPP-18436 | none | none | none | none | none | none | none |
| TPP-23411 (afuco) | none | none | none | none | none | none | none |

A first ELISA based experiment was performed to analyze unspecific binding to BVP, insulin or DNA for antibodies TPP-18206, TPP-17578, TPP-19546 and TPP-23411 and two reference antibodies. Unspecific binding of the inventive antibodies to insulin, DNA and/or BVP was lower than unspecific binding of the first reference antibody (Gantenerumab, Roche) to these antigens, and was also lower than unspecific binding of the second reference antibody (Remicade, Janssen Biotech) to these antigens.

Among the tested inventive antibodies, TPP-23411 showed the lowest polyreactivity for each of DNA, BVP and insulin.

bodies TPP-27495 (YTE), TPP-27496 (LS), TPP-18429, TPP-18430, TPP-18432, TPP-18433, TPP-18436, TPP-27479, TPP-27480 and control antibodies. Overall, the degree of polyreactivity was in an acceptable range for therapeutic applications for all inventive antibodies, independent of YTE or LS mutations.

Figure 17:
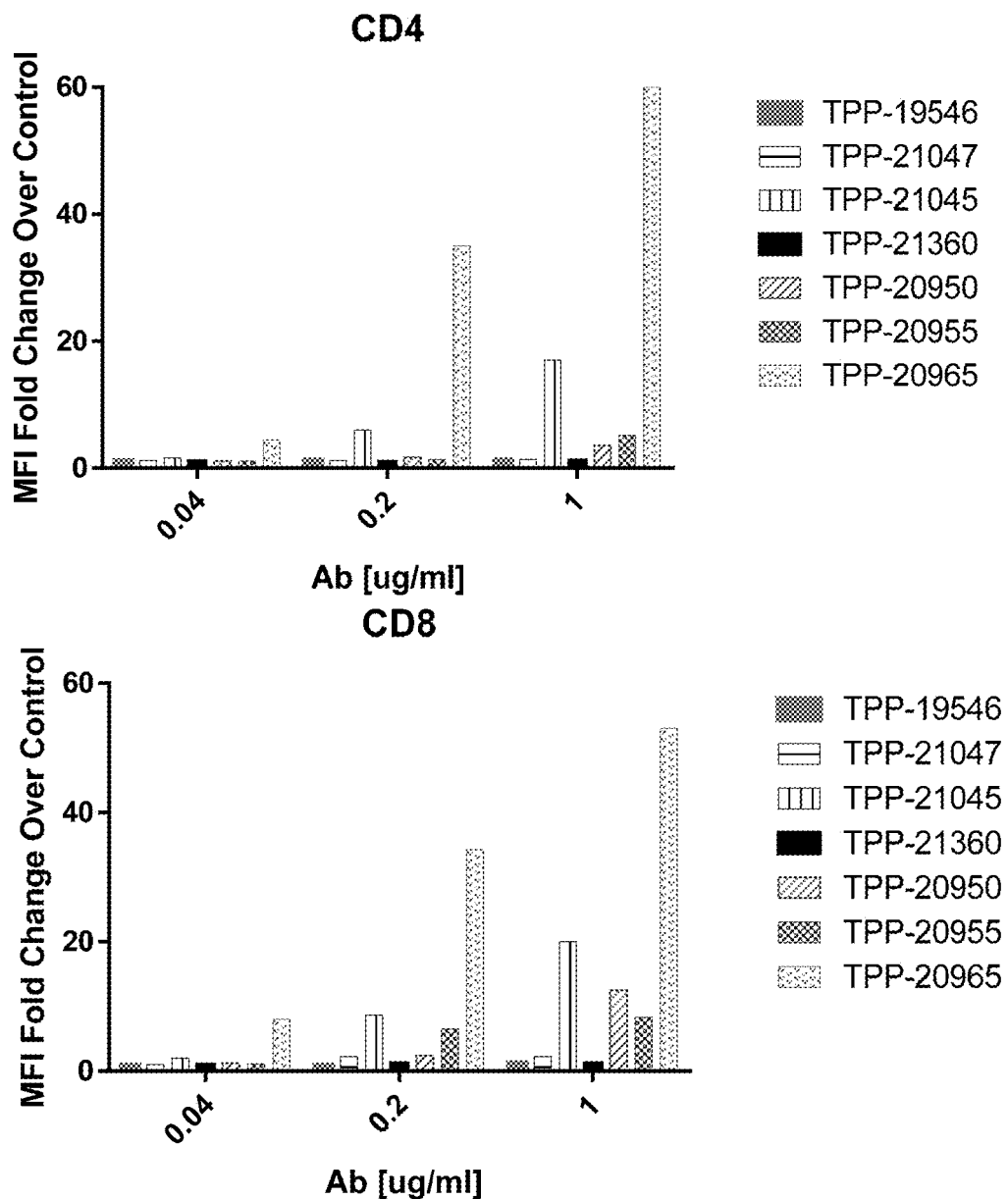
FIG. 17: Staining for CCR8 expression on different immune cell populations from healthy donor PBMCs (CD4+ T cells, CD8+ T cells, B cells as marked by CD19+ expression, Myeloid cells as marked by CD11b+ expression, CD4 T cells activated with anti-CD3 and anti-CD28 beads for 4 days, CD8+ T cells activated with anti-CD3 and anti-CD28 beads for 4 days).
Figure 17:
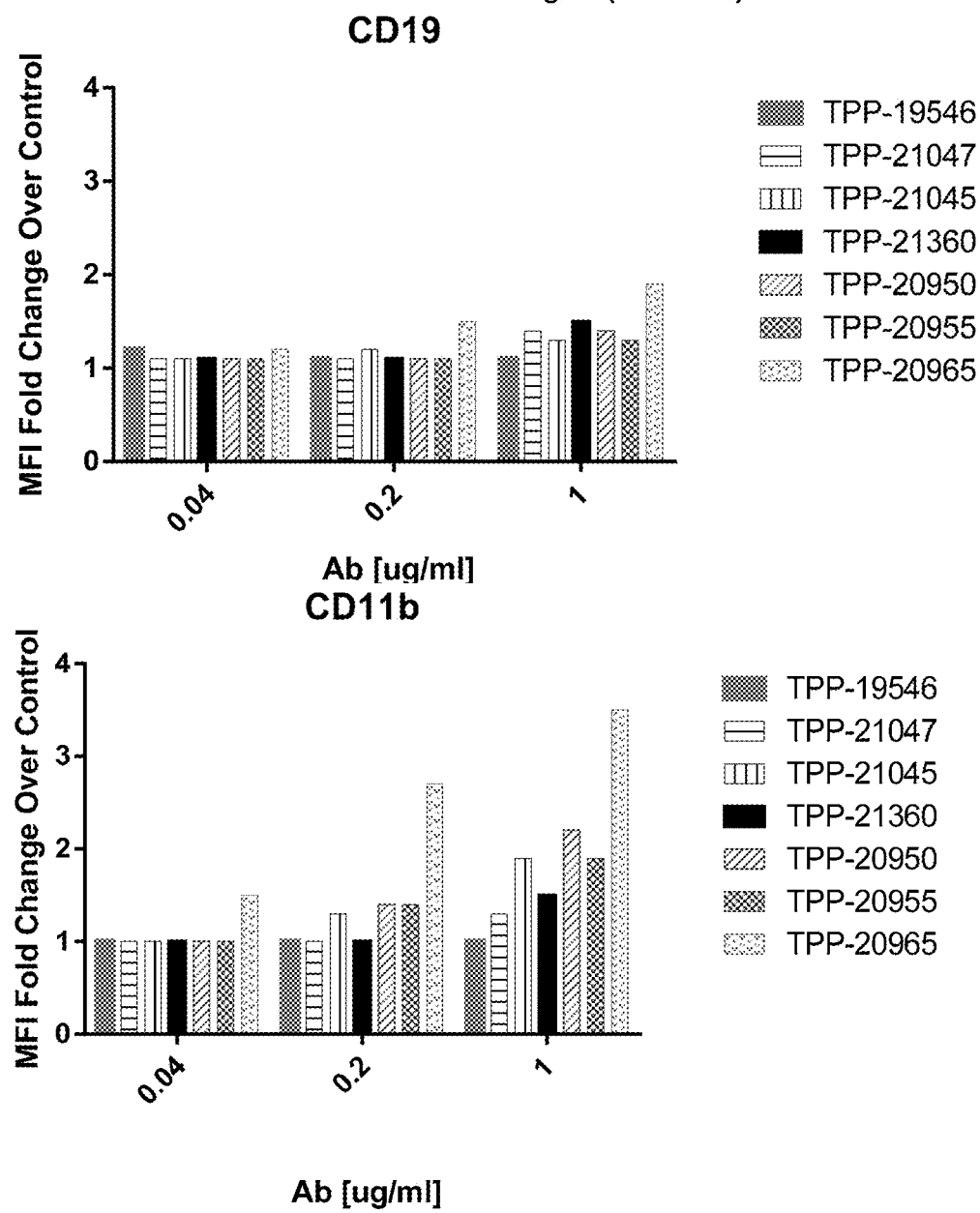
Figure 17:
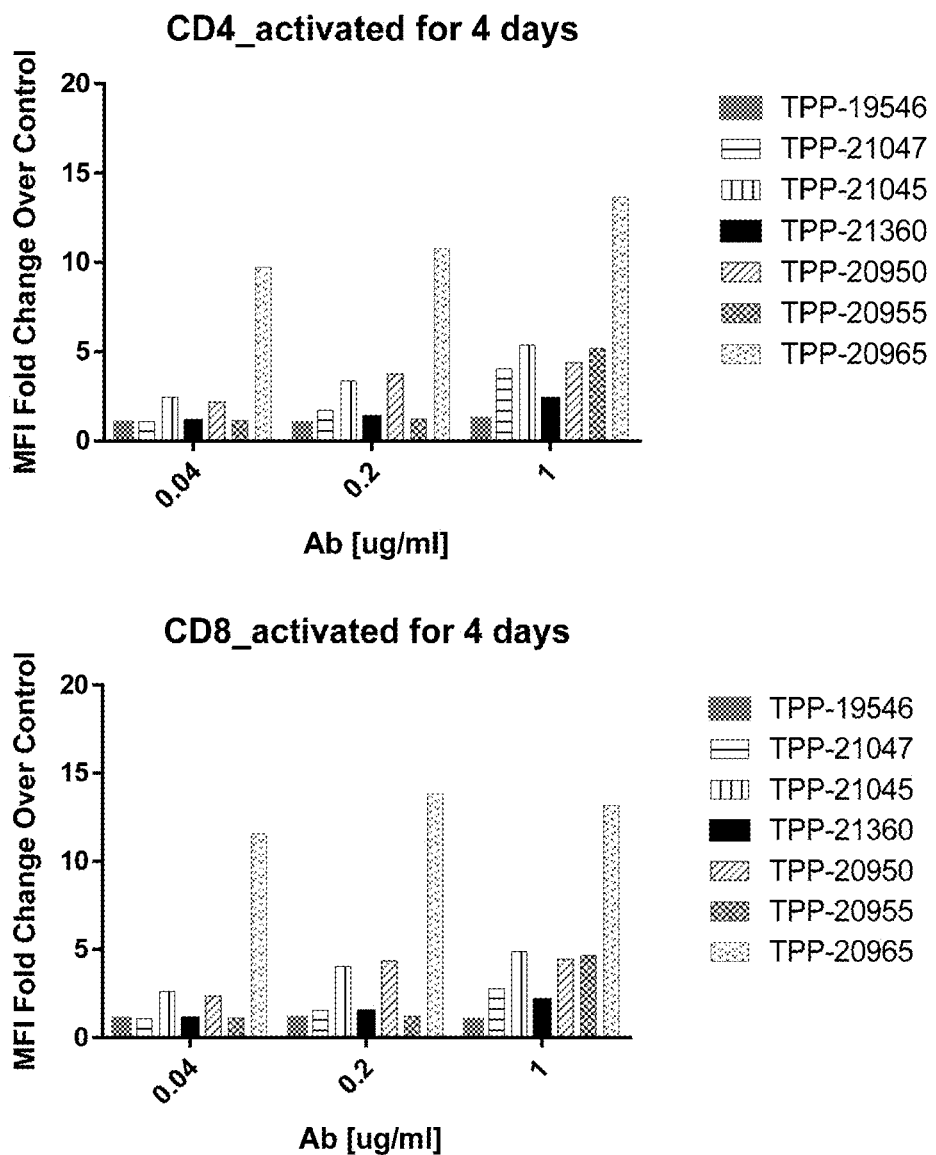

Unwanted binding of inventive CCR8 antibodies to immune cell populations different from human Tregs was analyzed by staining of these cell populations, cf. FIG. 17.

Figure 18:
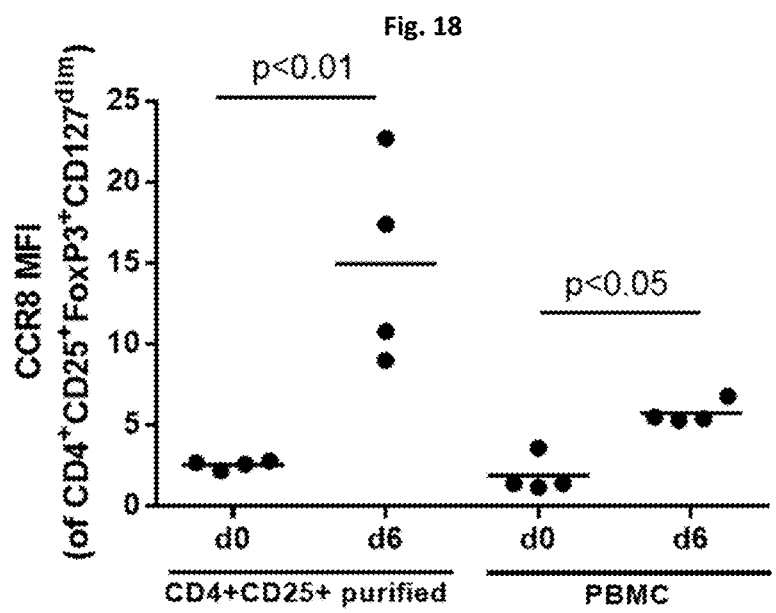
FIG. 18: CCR8 is upregulated on human Tregs after activation. After activation, the percentage of CCR8+ cells increased significantly in CD4+CD25+ purified cells with increased MFI while % of CCR8+ cells increased slightly in PBMC population. Anti-CCR8 antibody from BioLegend was used for these experiments. N=4 donors.

FIG. 18 shows upregulation of CCR8 on human Tregs after activation.

Example 10.3: Evaluation of ADCC and ADCP Induction

Example 10.3.1: Afucosylation of Antibodies

The antibodies according to the current invention were glycoengineered using GlymaxX technology, cf. U.S. Pat. No. 8,642,292, to improve the interaction between the antibodies FC region and the FC receptor expressed by the effector cells. In brief, the technology is based on the heterologous, cytosolic co-expression of bacterial enzyme GDP-6-deoxy-D-lyxo-4-hexulose reductase that redirects the de novo fucose synthesis pathway towards sugar-nucleotide GDP-Rhamnose that cannot be metabolized by eukaryotic cells. This depletes the fucose pool and leads to the production of afucosylated antibodies, both on the core part (no core fucose) and on the variable part (no antennary fucose) of an N-glycan. It also inhibits the fucosylation of O-glycans and protein-O-fucosylation. Removal of fucose from N-glycans on N297 resulted in an increased affinity to FcγRs, as shown in example 10.3.2.

Example 10.3.2: Human Fcγ Receptor Binding Analysis Based on SPR

To determine the ability of the inventive antibodies and their afucosylated versions to bind the respective FC receptors expressed on the human effector cells involved in ADCC or ADCP, SPR binding assays were performed on a T200 instrument at 25° C. with a CM5 sensor chip and assay buffer HBS-EP+500 mM NaCl. FcγR variants were captured via an amine coupled anti-His capture antibody (ab) and IgGs were used as analyte at concentrations up to 25 μM. KD values were derived from a steady state affinity analysis or from kinetic data fitted to a 1:1 Langmuir isotherm. Afucosylated versions of the antibodies showed increased binding to both human and cynomolgus FcgRIIIa, suggesting an improved ADCC induction and thus Treg depletion for the inventive antibodies in their afucoslyated form in both species (Table 10.3.2.1).

Furthermore, a comparable affinity for both, cynomolgus and human FcγRIII is important to model the ADCC efficacy in a cynomolgus animal model. These model systems are particularly important in tumor immunology because rodent models are often not suited to reflect immunological side effects of a therapeutic antibody. The afucosylated antibodies according to the current invention showed highly comparable affinities for the respective FC receptors in cynomolgus and human.

TABLE 10.3.2.1

SPR analysis of affinities of inventive antibodies for different FC receptors. Italics: approximation only as highest concentration was 25 μM and no saturation was reached; n.e.: not evaluable; n.b.: no binding; res. bdg.: residual binding, not quantitatively evaluable; KD >25 μM: fitted value outside of saturation. curve. TPP-9809: isotype control.

| KD [M] | Engineered | Human Fc gamma RI/CD64 | Human Fc gamma RIIA/CD32a (R167) | Human Fc gamma RIIIB/CD16b | Human Fc gamma RIIB/C (CD32b/c) | Human Fc gamma RIIIA/CD16a (V167) | Human Fc gamma RIIIA/CD16a (F176) (Acro) | Cyno Fc gamma RIII/CD16 | Cyno Fc gamma RIIA/CD32a | Cyno Fc gamma RIIB/CD32b |
|---|---|---|---|---|---|---|---|---|---|---|
| TPP-19546 | Afuco | 1.10E−08 | *2.20E−05* | 4.30E−06 | n.b. | 3.40E−07 | 4.20E−07 | 1.40E−07 | KD >25 μM | KD >25 μM |
| TPP-19546 |  | 1.80E−07 | n.b | n.b. | n.b. | 4.80E−06 | KD >10 μM | 3.10E−06 | n.b. | n.b. |
| TPP-20950 | Afuco | 1.10E−07 | *1.70E−05* | 4.60E−06 | KD >25 μM | 2.80E−07 | 3.70E−07 | 1.70E−07 | KD >25 μM | KD >25 μM |
| TPP-20950 |  | 1.80E−07 | n.b. | n.b. | n.b. | 7.60E−06 | KD >20 μM | 5.80E−06 | n.b. | n.b. |
| TPP-20955 | Afuco | 1.40E−07 | 6.20E−06 | 3.10E−06 | *9.80E−06* | 3.40E−07 | 4.20E−07 | 1.80E−07 | KD >25 μM | KD >25 μM |
| TPP-20955 |  | 2.80E−07 | n.b. | n.b. | n.b. | 8.90E−06 | KD >25 μM | 5.60E−06 | n.b. | n.b. |
| TPP-20965 | Afuco | 1.10E−07 | *1.60E−05* | 4.60E−06 | n.b. | 4.30E−07 | 5.20E−07 | 1.90E−07 | KD >25 μM | KD >25 μM |
| TPP-20965 |  | 2.00E−07 | KD >25 μM | n.b. | n.b. | 3.10E−06 | *7.60E−06* | *2.30E−05* | n.b. | n.b. |
| TPP-21045 | Afuco | 7.95E−09 | *1.06E−05* | 3.31E−06 | n.b. | 2.88E−07 | 3.16E−07 | 1.17E−07 | KD >25 μM | KD >25 μM |
| TPP-21045 |  | 7.62E−08 | KD >25 μM | n.b. | n.b. | 3.84E−06 | KD >25 μM | 2.23E−06 | n.b. | n.b. |
| TPP-21047 | Afuco | 7.73E−08 | 9.00E−06 | 2.97E−06 | KD >25 μM | 2.44E−07 | 2.68E−07 | 9.39E−08 | KD >25 μM | KD >25 μM |
| TPP-21047 |  | 7.26E−08 | *1.51E−05* | n.b. | KD >25 μM | 2.79E−06 | *1.01E−05* | 1.46E−06 | n.b. | n.b. |
| TPP-21360 | Afuco | 1.32E−07 | *1.22E−05* | 4.63E−06 | KD >25 μM | 4.01E−07 | 4.78E−07 | 1.74E−07 | KD >25 μM | KD >25 μM |
| TPP-21360 |  | 2.72E−07 | n.b | n.b. | n.b. | 5.76E−06 | KD >25 μM | 3.39E−06 | n.b. | n.b. |
| TPP-9809 | Afuco | 1.32E−07 | *1.29E−05* | 5.03E−06 | KD >25 μM | 4.59E−07 | 5.68E−07 | 2.13E−07 | KD >25 μM | KD >25 μM |
| TPP-9809 |  | 1.69E−07 | *1.74E−05* | KD >25 μM | KD >25 μM | 5.43E−06 | 1.38E−05 | 4.28E−06 | KD >25 μM | *KD >25 μM* |
| TPP-9809 | wild | 2.30E−07 | *1.77E−05* | *1.96E−05* | KD >25 μM | 5.57E−06 | *1.32E−05* | 2.26E−06 | KD >25 μM | *1.84E−05* |

Example 10.3.3: ADCC Induction Mediated by CCR8 Antibodies

Example 10.3.3.1: ADCC Induction Mediated by Anti-Human CCR8 Antibodies

For functional ADCC assays, either HEK cells expressing human CCR8 or activated human Tregs were used as target cells, and NK92v-GPF-CD16 176V (NantKwest) were used as effector cells. In a 96 well tissue culture treated plate, a co-culture of the respective target cells expressing CCR8 with effector cells at a ratio of 4:1 in the presence of various concentration of therapeutic antibody were incubated in RPMI 1640 with 1% heat inactivated FBS, 100 U/ml Pen/Strep, 1 mN Na-pyruvate, and 1×NEAA. Digitonin was used for maximum lysis, and CytoTox-Glo (Promega) was added to the assay at the end of a 2 hr incubation. Raw luminescent values were determined using the CytoTox-glo Promega program. The Mean Max Background, MMB=(Target Max)−(Target Spontaneous) is used to calculate % lysis. % Lysis=(Raw Luminescent−no ab)/MMB×100.

Figure 19:
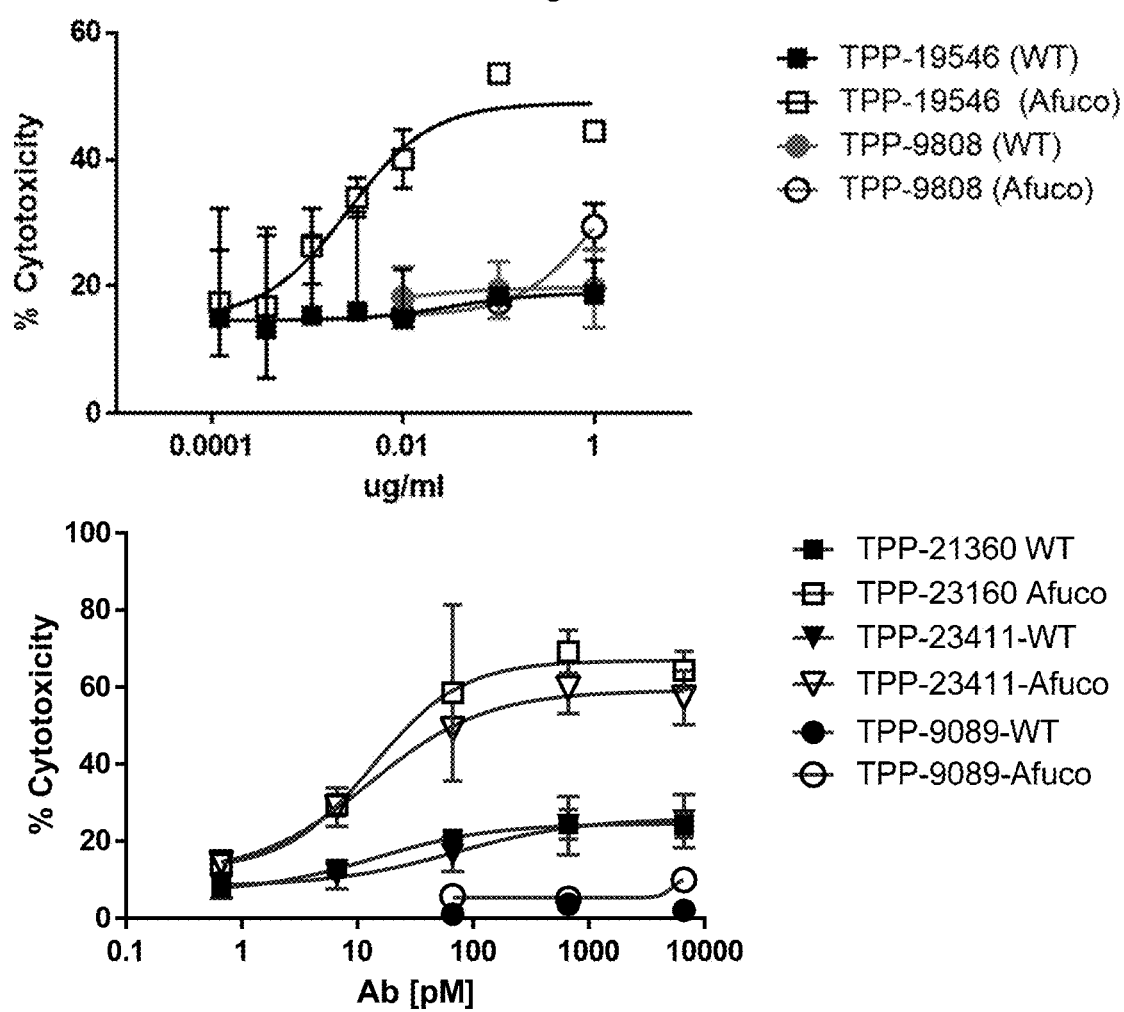
FIG. 19: ADCC induced by wild type or afucosylated inventive antibodies TPP-19546, TPP-21360 or TPP-23411 in HEK cells expressing human CCR8 as target cells. Isotype control: TPP-9808.
Figure 20:
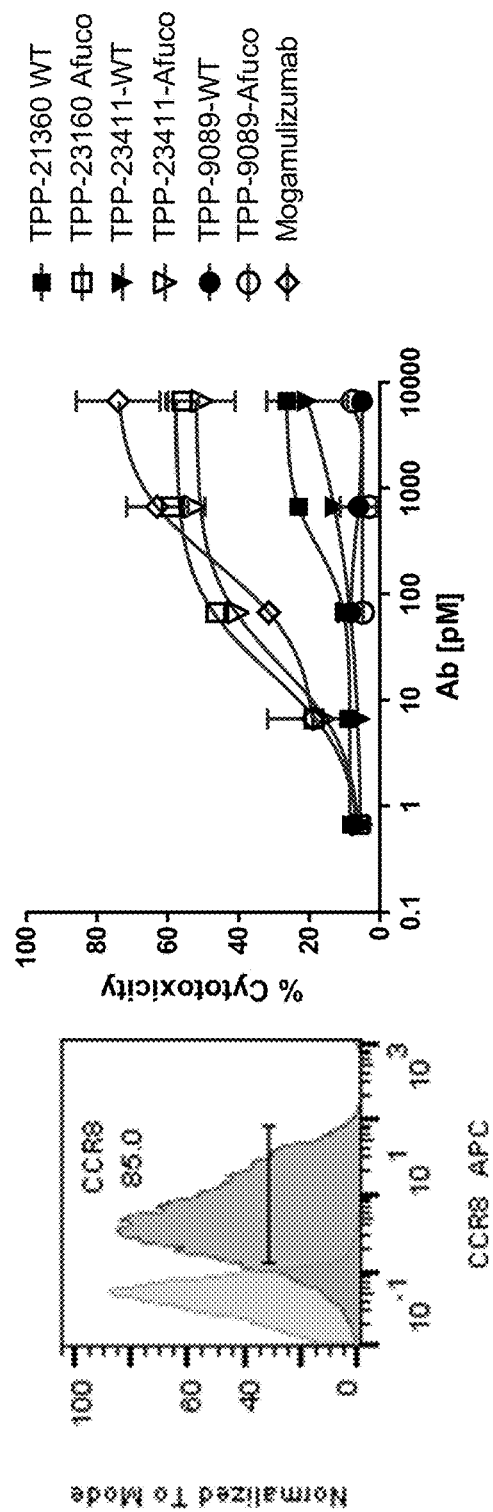
FIG. 20: Left: Percent CCR8+ expression on day 3 for activated human Tregs as target cells. Right: ADCC induced by wild type or afucosylated inventive antibody TPP-21360, TPP-23411 in activated human Tregs as target cells. Isotype control: TPP-9808. Results were reproducible in different donors (data not shown).

For antibody candidates TPP-19546 (upper panel) and TPP-21360 (lower panel), afucosylation increased ADCC induced cytotoxicity to ~50 and ~70% respectively in HEK cells expressing human CCR8 (cf. FIG. 19). On activated human Tregs with about 85% CCR8 expression, ADCC derived cytotoxicity resulting from afucosylated TPP-21360 or TPP-23411 was as high as 59% or 52% (cf. FIG. 20, Table 10.3.3.1.3). For afucosylated TPP-21360 the average EC50 of % cytotoxicity for activated human Tregs with about 85% CCR8 expression using NK92v as effector cells was ~20 pM. Tables 10.3.3.1.1 to 10.3.3.1.6 show the results for different inventive antibodies and/or different donors.

TABLE 10.3.3.1.2

ADCC assay summary: EC50 and Max response using activated Tregs as target cells and NK92v cell line as effector cells. All TPPs used in this assay were afucosylated.
ADCC potency (Donor 1100)

| | TPP-19546 | TPP-21360 | TPP-20945 | TPP-20950 | TPP-20955 | Iso afuco | Moga |
|---|---|---|---|---|---|---|---|
| hTreg $EC_{50}$ (pM) | 8840 | 4.41 | 3.2 | 9.51 | 5.82 | NA | 35.2 |
| Max Response (%) | 54 | 98 | 96 | 97 | 91 | 36 | 96 |
| $R^2$ | 0.75 | 0.80 | 0.61 | 0.89 | 0.50 | NA | 0.94 |

TABLE 10.3.3.1.3

ADCC assay summary: EC50 and Max response using activated Tregs as target cells and NK92v cell line as effector cells. The activated human Treg used in this study had about 85% CCR8 expression.
ADCC potency (Donor 1100)

| | TPP-21360 | | TPP-23411 | | TPP-9809 | | |
|---|---|---|---|---|---|---|---|
| | WT | Afuco | WT | Afuco | WT | Afuco | Moga |
| hTreg $EC_{50}$ (pM) | 271 | 18.5 | 10763 | 22.1 | NA | NA | 193.4 |
| Max Response (%) | 26 | 59 | 27 | 52 | 8 | 8 | 74 |
| R2 | 0.97 | 0.98 | 0.61 | 0.96 | NA | NA | 0.89 |

TABLE 10.3.3.1.1

ADCC assay summary: EC50 and Max response using activated Tregs as target cells and NK92v cell line as effector cells.
ADCC Potency

| | | Donor 1730 | | Donor 1213 | |
|---|---|---|---|---|---|
| Antibody | Isotype | $EC_{50}$ (nM) | Max Response (%) | $EC_{50}$ (nM) | Max Response (%) |
| TPP-17577 | WT | 5.76E+11 | 13 | ~7.98e+014 | 10 |
| | Afuco | 4.57 | 40 | 1.85 | 41 |
| TPP-18342 | WT | 1.50 | 15 | 0.37 | 25 |
| | Afuco | 0.28 | 40 | 0.295 | 62 |
| TPP-17578 | WT | 1.97E+05 | 8 | | 5 |
| | Afuco | 19.0 | 38 | 9.2 | 25 |
| TPP-18205 | WT | ~1.8e−2 | 24 | ~5.58e−3 | 20 |
| | Afuco | 1.05 | 58 | 0.23 | 52 |
| TPP-18206 | WT | 4.68 | 12 | 8.59E+15 | 4 |
| | Afuco | 1.68 | 51 | 0.23 | 47 |
| TPP-9809 | Afuco | | 6 | | 4 |
| Mogamulizumab | | 1.09 | 65 | 0.31 | 58 |

TABLE 10.3.3.1.4

ADCC assay summary: EC50 and Max response using activated Tregs as target cells and NK92v cell line as effector cells. The activated human Treg used in this study had only about 31% CCR8 expression.

ADCC potency (Donor 1261)

|  | TPP-21360 | | TPP-23411 | | TPP-9809 | | |
| --- | --- | --- | --- | --- | --- | --- | --- |
|  | WT | Afuco | WT | Afuco | WT | Afuco | Moga |
| hTreg $EC_{50}$ (pM) | 81.3 | 65.6 | ~157 | 55.9 | NA | NA | 86.4 |
| Max Response (%) | 13 | 25 | 8 | 24 | 2 | 3 | 71 |
| $R^2$ | 0.27 | 0.90 | 0.30 | 0.64 | NA | NA | 0.97 |

TABLE 10.3.3.1.5

ADCC assays: EC50 and Max response using HEK cells expressing human CCR8 (>95% CCR8) as target cells and NK92v cell line as effector cells.

ADCC Potency: HEK-hCCR8 + NK92v

| Afucosylated | TPP-27479 | TPP-27478 | TPP-23411 | TPP-9809 |
| --- | --- | --- | --- | --- |
| EC50 (pM) | 363 | 110 | 141 | N/A |
| Max Response (%) | 32 | 35 | 35 | 17 |
| $R^2$ | 0.94 | 0.82 | 0.85 | N/A |

ADCC Potency: HEK-hCCR8 + NK92v

| Afucosylated | TPP-29369 | TPP-29367 | TPP-23411 | TPP-9809 |
| --- | --- | --- | --- | --- |
| EC50 (pM) | 26.3 | 137 | 68.7 | N/A |
| Max Response (%) | 38 | 22 | 34 | 7 |
| $R^2$ | 0.65 | 0.36 | 0.71 | N/A |

TABLE 10.3.3.1.6

ADCC assays: EC50 and Max response using HEK cells expressing human CCR8 (>95% CCR8) as target cells and NK92v cell line as effector cells.

ADCC Potency: HEK-hCCR8 + NK92v

| Afucosylated | TPP-29369 | TPP-29367 | TPP-23411 | TPP-29368 | TPP-9809 |
| --- | --- | --- | --- | --- | --- |
| EC50 (pM) | 99 | 460 | 167 | 2892 | N/A |
| Max Response (%) | 36 | 31 | 41 | 25 | 20 |
| $R^2$ | 0.91 | 0.83 | 0.89 | 0.72 | N/A |

ADCC Potency: HEK-hCCR8 + NK92v

| n = 2 | TPP-27479 | TPP-27478 | TPP-23411 | TPP-29368 | TPP-9809 |
| --- | --- | --- | --- | --- | --- |
| EC50 (pM) | 823 | 11 | 182 | 2292 | N/A |
| Max Response (%) | 25 | 32 | 25 | 26 | 8 |
| $R^2$ | 0.67 | 0.57 | 0.66 | 0.36 | N/A |

Example 10.3.3.2: ADCC Induction Mediated by Anti-Mouse CCR8 Antibodies (Surrogate Antibodies)

To compare the behavior of the inventive human anti-human/cyno CCR8 antibodies with the inventive human anti-murine CCR8 surrogate antibodies, the latter were likewise characterized for ADCC induction. The functional ADCC assay for the surrogate antibodies was performed using primary murine NK cells as effector cells and murine CCR8 expressing HEK293 cells and BW 5417.3 (data not shown) as target cells. Ultra-low IgG containing medium was used during coculturing to avoid unspecific binding of CCR8 antibodies to serum IgGs. Furthermore, to more closely reflect the in vivo situation, target cells were first preincubated with surrogate CCR8 antibodies before effector cells were added, allowing for better FcγRIII clustering on effector cells, that is the early step of ADCC mode-of-action. Effector and target cells were cocultured at a ratio of 10:1 in RPMI 1640 with 1% Ultra-low IgG FBS One Shot medium for 20 hours using U-bottom 96-well plates. Surrogate anti-murine CCR8 antibody TPP-15285 and isotype control antibody TPP-10748 were used in various concentration steps. Cytotoxicity was determined using the Cyto-Tox-Glo™ Cytotoxicity Assay (Promega) (% Cytotoxicity= [(Experimental value−Control w/o antibody/(Maximal lysis of target cells−Spontaneous lysis of target cells)]×100%). Experimental values were determined by coculture of target cells with effector cells after addition of surrogate CCR8 antibodies. Control values were determined by coculture of target cells with effector cells without addition of inventive antibodies. Maximal lysis values were determined for target cells where Digitonin had been added at the start of the assay. Spontaneous lysis values were determined by measuring the spontaneous lysis of target cells in assay medium without addition of any further reagents. 92% to 97% of target cells showed expression of murine CCR8 (determined by FACS). The ADCC-related cytotoxicity for TPP-15285 was ~39% and the mean EC50 was ~111 μM (Table 10.3.3.2.1). The highest inventive antibody concentration resulted in a hook effect, further supporting the suggested ADCC-based mode-of-action. The optimized functional ADCC assay thus confirmed that ADCC is a relevant mode of action for the in vivo efficacy of the inventive surrogate CCR8 antibodies and thus confirm the suitability of anti-murine CCR8 antibody TPP-15285 as surrogate antibody for the anti-human CCR8 antibodies.

TABLE 10.3.3.2.1

ADCC assay summary using fucosylated (wild type) surrogate CCR8 antibodies.

ADCC potency (wild type)

|  | TPP-15285 | TPP-10748 |
| --- | --- | --- |
| $EC_{50}$ (pM) | 111 | NA |
| Max Response (%) | 39 | 7 |
| $R^2$ | 0.89 | NA |

TABLE 10.3.3.2.2

ADCC assays showing cytotoxicity in % induced by wild type surrogate CCR8 antibody TPP-15285 (4 replicates).

| ng/ml | TPP-15285 | | | | TPP-10748 | | | |
|---|---|---|---|---|---|---|---|---|
| 10000 | 15.02 | 36.48 | 33.42 | 20.33 | −1.62 | 5.23 | 6.95 | −8.48 |
| 1000 | 15.04 | 38.89 | 39.03 | 35.56 | −0.77 | −2.64 | 3.93 | −0.76 |
| 100 | 22.44 | 29.84 | 28.11 | 43.39 | 3.27 | 3.99 | −0.64 | −1.41 |
| 10 | −2.14 | 8.68 | 3.88 | 35.69 | 11.76 | −1.64 | −7.4 | 1.79 |
| 1 | −8.82 | −7.13 | 5.02 | 11.33 | 5.46 | −3.06 | −5.7 | −0.72 |
| 0.1 | −8.4 | −2.87 | 5.78 | 9.85 | 10.44 | −8.69 | 4.64 | −0.8 |
| 0.01 | −12.68 | −2.77 | 10.75 | | 3.8 | 1 | 5.51 | |

Example 10.3.4: ADCP Induction Mediated by Anti-CCR8 Antibodies

Example 10.3.4.1: ADCP Induction Mediated by Anti-Human CCR8 Antibodies

Figure 21:
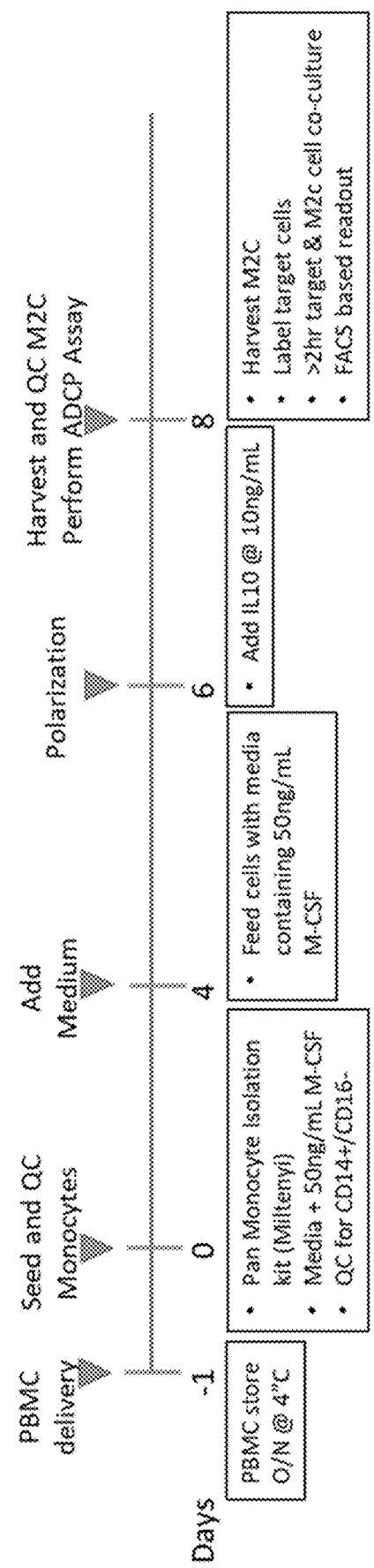
FIG. 21: Protocol for ADCP assay.

To generate macrophage (M2c) effector cells, CD14+ cells were negatively selected (Miltenyi) from PBMC of healthy donors (AllCells). M2c macrophage differentiation was performed according to an eight days differentiation protocol provided by StemCell Tech (see FIG. 21). On the assay day, M2c were stained for expression of CD16, CD32, CD64, CD163, CD206, CD11b, CD80, and CD14 using FACS. The target cells were either HEK cells expressing human CCR8 or activated human Treg cells. Briefly, the target cells were labeled with carboxyfluorescein succinimidyl ester (CFSE) (ThermoFisher) according to the manufacturer's instructions. The target cells were incubated in a co-culture in 96 well plates with different concentrations of antibodies and effector cells at target to effector ratio of 4:1. In these assays, anti-CD47 (positive control) was added at 1 µg/ml; this gives enhanced response as it blocks do not eat me signal. After 3-4 hours incubation, the samples were run on MACSQuant or Attune flow cytometer. % phagocytosis was determined by CD206+CFSE+ double positive cells. CD206 is a marker expressed on macrophages.

M1 macrophages were generated similarly and from the same source material (fresh PBMC). In brief, CD14+ cells were isolated by negative selection and cultured for four days in serum-free media (StemCell Tech Immnocult) with 50 ng/mL M-CSF. However, at day 5, M1 macrophages were polarized by addition of 1 Ong/mL LPS+50 ng/mL IFN-g whereas M2c macrophage were polarized with the addition of 10 ng/mL IL-10.

Figure 22:
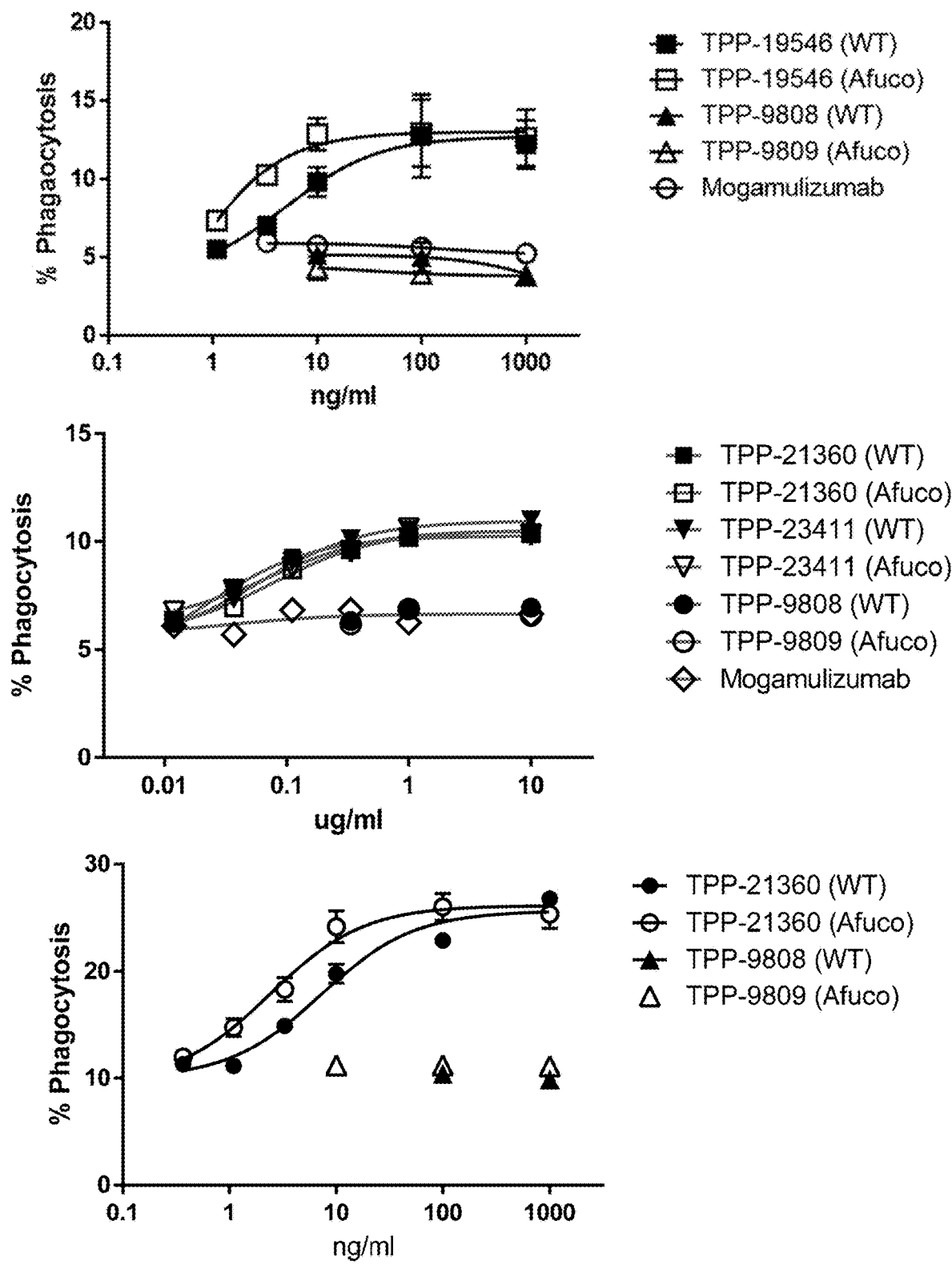
FIG. 22: ADCP assay for wild type and afucosylated versions of inventive antibodies shows induction of phagocytosis in HEK cells expressing human CCR8 as target cells with in vitro differentiated M2c macrophages as effector cells. Wild type and afucosylated versions of inventive antibodies TPP-19546, TPP-21360 and TPP-23411 induced ADCP. TPP-9808 is the isotype control. Mogamulizumab is a marketed anti-CCR4 antibody.

FIG. 22 shows induction of phagocytosis in HEK cells expressing human CCR8 as target cells with in vitro differentiated macrophages M2c as effector cells. Both, wild type and afucosylated versions of inventive antibodies TPP-19546, TPP-21360 and TPP-23411 induced ADCP. FIGS. 23 and 24 and Tables 10.3.4.1.1 to 10.3.4.1.7 show the ADCP induction as characterized by EC50 and maximal response for multiple inventive antibodies, multiple donors and different macrophage populations. For all antibodies, a substantial degree of ADCP was observed.

TABLE 10.3.4.1.1

ADCP assay summary: EC50 and Max response using activated Tregs as target cells and M2c macrophages as effector cells. All the TPPs used in this assay were afucosylated. TPP-9809 is the isotype control. For human Treg donor 1212 CCR8 was expressed by 40% of cells.
ADCP Potency (hTreg Donor 1212 + M2c Donor)

| | TPP-19546 | TPP-21045 | TPP-21360 | TPP-20950 | TPP-20955 | TPP-9809 |
|---|---|---|---|---|---|---|
| EC50 (pM) | NA | 1220 | 577 | 128 | 408 | NA |
| Max Response (%) | 20 | 30 | 39 | 32 | 29 | 15 |
| $R^2$ | NA | 0.49 | 0.88 | 0.71 | 0.83 | NA |

TABLE 10.3.4.1.2

ADCP assay summary: EC50 and Max response using activated Tregs as target cells and M2c macrophages as effector cells. TPP-9809 is isotype control. For human Treg donor 1163 CCR8 was expressed by 67% of cells.
ADCP Potency (hTreg Donor 1163 + M2c Donor 1)

| | TPP-19546 | | TPP-21045 | | TPP-21360 | TPP-20965 | TPP-9809 | |
|---|---|---|---|---|---|---|---|---|
| | WT | Afuco | WT | Afuco | Afuco | Afuco | WT | Afuco |
| EC50 (pM) | NA | NA | 130 | 30.1 | 205 | 766 | NA | NA |
| Max Response (%) | 14 | 15 | 27 | 28 | 39 | 44 | 11 | 10 |
| $R^2$ | NA | NA | 0.95 | 0.88 | 0.96 | 1.0 | NA | NA |

TABLE 10.3.4.1.3

ADCP assay summary: EC50 and Max response using activated Tregs as target cells and M2c macrophages as effector cells. TPP-9809 is isotype control. For human Treg donor 1163 CCR8 was expressed by 67% of cells.
ADCP Potency (hTreg Donor 1163 + M2c Donor 2)

| | TPP-19546 | | TPP-21045 | | TPP-21360 | TPP-20965 | TPP-9809 | |
|---|---|---|---|---|---|---|---|---|
| | WT | Afuco | WT | Afuco | Afuco | Afuco | WT | Afuco |
| EC50 (pM) | ~1.688e+007 | 404.4 | 162 | 52.9 | 105 | 300 | NA | NA |
| Max Response (%) | 18 | 18 | 27 | 28 | 37 | 36 | 11 | 14 |
| $R^2$ | 0.94 | 0.87 | 0.98 | 0.95 | 0.97 | 0.98 | NA | NA |

TABLE 10.3.4.1.4

ADCP assay summary: EC50 and Max response using activated Tregs as target cells and M2c macrophages as effector cells. TPP-9809 is isotype control. For human Treg donor 1212 CCR8 was expressed by 40% of cells.
ADCP Potency (human Treg Donor 1212 + M2c Donor 3)

| Afucosylated | TPP-20965 | TPP-21360 | TPP-21045 | TPP-20950 | TPP-20955 | TPP-9809 |
|---|---|---|---|---|---|---|
| EC50 (pM) | 163 | 51 | 9.2 | 23 | 14 | NA |
| Max Response (%) | 14 | 14 | 13 | 14 | 13 | 7 |
| $R^2$ | 0.99 | 0.96 | 0.79 | 0.93 | 0.96 | NA |

TABLE 10.3.4.1.5

ADCP assay summary: EC50 and Max response using activated Tregs as target cells and M2c macrophages as effector cells. TPP-9809 is isotype control. For human Treg donor 1212 CCR8 was expressed by 40% of cells.
ADCP Potency (human Treg Donor 1212 + M2c Donor 4)

| Afucosylated | TPP-20965 | TPP-21360 | TPP-21045 | TPP-20950 | TPP-20955 | TPP-9809 |
|---|---|---|---|---|---|---|
| EC50 (pM) | 563 | 27.5 | 17.1 | 10.7 | 13.2 | NA |
| Max Response (%) | 23 | 23 | 23 | 24 | 23 | 14 |
| $R^2$ | 0.93 | 0.99 | 0.99 | 0.97 | 0.98 | NA |

TABLE 10.3.4.1.6

ADCP assay summary: EC50 and Max response using activated Tregs as target cells and M2c macrophages as effector cells. TPP-9809 is isotype control.
ADCP Potency (human Treg Donor 1100 + M2c Donor 5)

| | TPP-21360 | | TPP-23411 | | TPP-9809 | |
|---|---|---|---|---|---|---|
| | WT | Afuco | WT | Afuco | WT | Afuco |
| EC50 (pM) | 1855 | 2003 | 1607 | 2188 | NA | NA |
| Max Response (%) | 25 | 25 | 26 | 26 | 19 | 21 |
| $R^2$ | 0.94 | 0.90 | 0.87 | 0.90 | NA | NA |

TABLE 10.3.4.1.7

ADCP assay summary: EC50 and Max response using activated Tregs as target cells and M2c macrophages as effector cells. TPP-9809 is isotype control.
ADCP Potency (human Treg Donor 261 + M2c Donor 6)

| | TPP-21360 | | TPP-23411 | | TPP-9809 | |
|---|---|---|---|---|---|---|
| | WT | Afuco | WT | Afuco | WT | Afuco |
| EC50 (pM) | 870 | 664 | 1257 | 613 | NA | NA |
| Max Response (%) | 24 | 23 | 23 | 23 | 17 | 18 |
| $R^2$ | 0.99 | 0.97 | 0.95 | 0.97 | NA | NA |

TABLE 10.3.4.1.7

ADCP assay summary with Incucyte live-imaging: EC50 and Max response using macrophages as effector cells and human CCR8 expressing HEK cells as target cells at ratio of 4:1. Human CCR8 expression was 80%. TPP-9809 is isotype control. M2c macrophages were plated into ultralow attachment 96-well-plates. After addition of the therapeutic antibodies in various concentrations the pHrodo red dye (Sartorius #4649) labeled target cells were added and plates were incubated at 37° C. and 5% $CO_2$. Phase contrast and red fluorescence images were automatically acquired and analyzed every 30 min for 12 hours using 20× objective in Incucyte S3 (4 pictures/well in triplicates). ADCP induction varied for tested therapeutic wild type antibodies.
ADCP Potency (human CCR8-HEK + M2c Donor)

| | TPP-23411 | TPP-29368 | TPP-29369 | TPP-27478 | TPP-27479 | TPP-9809 |
|---|---|---|---|---|---|---|
| EC50 (pM) | 227 | 326 | 102 | 151 | 79.5 | NA |
| Max Response (%) | 13.7 | 15.0 | 13.3 | 10.9 | 9.8 | 6.7 |
| $R^2$ | 0.97 | 0.97 | 0.96 | 0.93 | 0.95 | NA |

Example 10.3.4.2: ADCP Induction Mediated by Anti-Murine CCR8 Antibodies (Surrogate Antibodies)

To compare the behavior of the inventive human anti-human/cyno CCR8 antibodies with the inventive human anti-murine CCR8 surrogate antibodies, the latter were likewise characterized for ADCP induction. For the functional ADCP assay primary murine bone marrow derived M2 macrophages were used as effector cells and murine CCR8 expressing HEK293 cells and BW 5417.3 cells (data not shown) as target cells. To generate the effector cells, murine bone marrow derived macrophages were plated into 24-well plate and polarized into M2 macrophages by addition of 20 ng/ml M-CSF, 0.05 µg/ml IL-4 and 0.05 µg/ml IL-13. Target cells were labeled with carboxyfluorescein succinimidyl ester dye (CFSE, ThermoFisher) and were added to effector cells in effector to target ratio of 2:1. Finally, surrogate anti-murine CCR8 antibody TPP-15285 and isotype control TPP-10748 were added in various concentrations. After 2 hours of coculturing cells were stained for murine M2 macrophage marker F4/80 and % of phagocytosis was determined using flow cytometry measuring the fraction of F4/80+ and CFSE+ double positive macrophages. 92% to 97% of target cells showed expression of murine CCR8 (as determined by FACS). Phagocytosis induced by TPP-15285 was ~11% and the mean EC50 was ~402 µM (Table 10.3.4.2.1). The highest antibody concentration resulted in a hook effect, further supporting the suggested mode of action. The optimized functional ADCP assay further confirmed that ADCP is a relevant mode of action for the in vivo efficacy of the inventive surrogate CCR8 antibodies and thus confirm the suitability of anti-murine CCR8 antibody TPP-15285 as surrogate antibody for the anti-human CCR8 antibodies.

TABLE 10.3.4.2.1

ADCP assay summary using fucosylated (wild type) surrogate CCR8 antibodies.

| | TPP-15285 | TPP-10748 |
|---|---|---|
| EC50 (pM) | 402 | NA |
| Max Response (%) | 11 | 5 |
| $R^2$ | 0.93 | NA |

TABLE 10.3.4.2.2

ADCP assay using surrogate CCR8 antibodies.

| ng/ml | TPP-15285 | | TPP-10748 | |
|---|---|---|---|---|
| 10000 | 9 | 9.28 | 4.26 | 4.47 |
| 1000 | 10.33 | 11.61 | 4.96 | 4.12 |
| 100 | 8.3 | 8.79 | 4.93 | 5.61 |
| 10 | 4.99 | 4.49 | 3.6 | 4.12 |
| 1 | 4.34 | 4.28 | 3.59 | 4.54 |

Example 10.4: Modulation of CCR8 Signaling by CCR8 Antibodies

CCL1 is a specific ligand of CCR8. Upon binding to CCR8, CCL1 can induce calcium (Ca) flux, chemotaxis, and—via β-arrestin signaling—receptor internalization, the latter being possibly independent of G protein signaling. There are at least 6 different ways an antibody can modulate a GPCR:
1. An inverse agonist, upon binding, quiets the potential endogenous activation of the GPCR. For CCR8 the endogenous activation can be e.g. ~10%.
2. An antagonist biased to β-arrestin or G-protein blocks either G-protein dependent signaling or β-arrestin signaling and has no effect on the respective other pathway.
3. A neutral antagonist can block both G-protein and β-arrestin signaling pathways.
4. A full agonist activates both G-protein and β-arrestin signaling pathways.
5. An agonist biased to β-arrestin or G-protein activates either G-protein signaling or β-arrestin signaling pathways, but not both.
6. A dimerization promoting agonist crosslinks two GPCRs, e.g. with the different arms of the antibody, resulting in various signaling activities For an ADCC and ADCP based approach for depleting intra-tumoral Tregs, it would be ideal to exclude any potential signaling effects that an antibody can have on CCR8. To assess this, the inventors used Ca flux assay as a readout for G-protein dependent signaling, and β-arrestin activation and phospho signaling as a readout for G-protein independent signaling pathways. Phospho Erk1/2 is involved in the MAP kinase pathway and regulates a variety of cellular responses, while phospho AKT is well known to be associated with the PI3 kinase pathway and has been shown in CCR8 to be involved in promoting chemotaxis. AKT pathway is also involved in promoting cell survival and growth, and recently, CCL1 has been shown to promote survival of CCR8 expressing cells (Barsheshet, Yiftah, et al. "CCR8+ FOXp3+ Treg cells as master drivers of immune regulation." Proceedings of the National Academy of Sciences 114.23 (2017): 6086-6091.).

Example 10.4.1: DiscoverX Assay for Monitoring of β-Arrestin Signaling

In response to a stimulus, i.e. the binding of a ligand—such as CCL1 for CCR8—GPCRs can activate G-protein independent signaling, such as β-arrestin signaling. This can result in the internalization of the chemokine receptor (Fox, James M., et al. "Structure/Function Relationships of CCR8 Agonists and Antagonists. Amino-terminal extension of CCL1 by a single amino acid generates a partial agonist." Journal of Biological Chemistry 281.48 (2006): 36652-36661). The β-arrestin assay was purchased from DiscoverX. In brief, CCR8 is fused in frame with a small enzyme donor fragment ProLink™ (PK) and co-expressed in cells stably expressing a fusion protein of β-arrestin and the larger, N-terminal deletion mutant of β-galactosidase (called enzyme acceptor or EA). Activation of CCR8 stimulates binding of β-arrestin to the PK-tagged CCR8 and forces complementation of the two enzyme fragments, resulting in the formation of an active β-galactosidase enzyme. This interaction leads to an increase in enzyme activity that can be measured using chemiluminescent PathHunter Detection Reagents.

Figure 25:
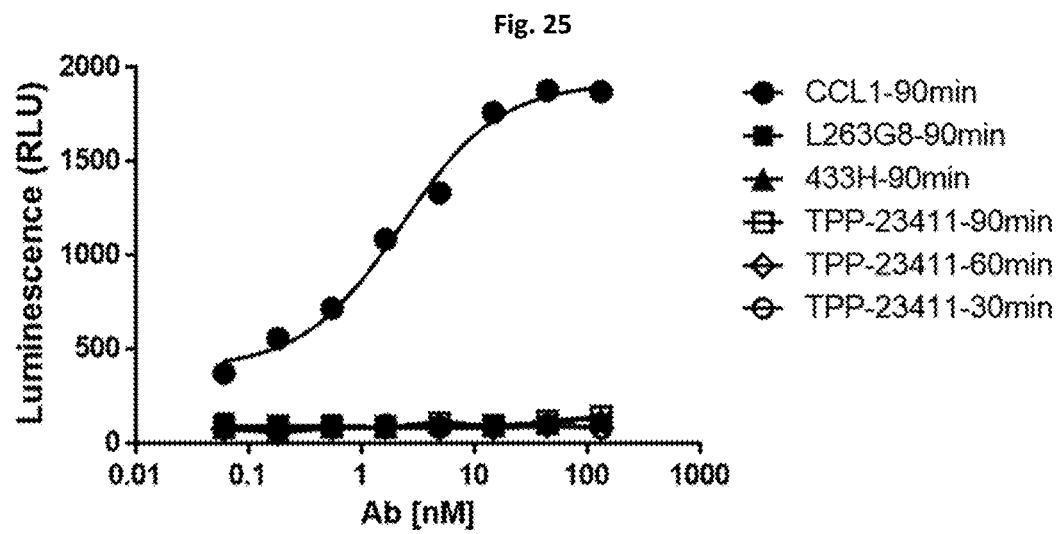
FIG. 25: Activation of β-arrestin signaling measured with the DiscoverX assay for CCL1, TPP-23411, L263G8, or 433H on CHO cells co-expressing human CCR8 tagged with ProLink and EA. As expected, CCR8 ligand CCL1 (human) induces β-arrestin signaling. An extra timepoint was analyzed for TPP-23411 to ensure that no β-arrestin activation happened at earlier time points. None of the analyzed antibodies induced β-arrestin signaling activation.

In a first experiment, antibody or CCL1 was incubated with the CHO cells co-expressing human CCR8 tagged with ProLink and EA for 90 min before adding detection agent. Neither the prior art antibodies nor the inventive antibodies induced β-arrestin signaling (FIG. 25).

Figure 26:
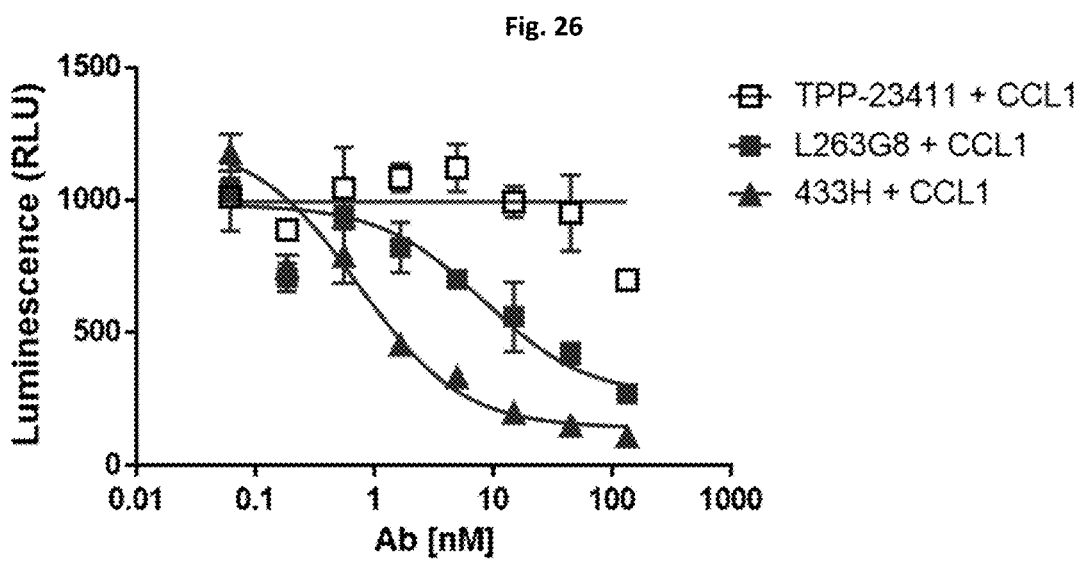
FIG. 26: Evaluation of blocking of CCL1 induced β-arrestin signaling by TP-23411, L263G8, or 433H, measured with the DiscoverX assay. CCL1 was used at its EC80 (20 ng/ml). Prior art antibodies L263G8, and 433H both blocked β-arrestin signaling induced by CCL1 at low antibody concentration, while inventive antibody TPP-23411 showed no effect at these concentrations. β-arrestin signaling has been suggested to play a role in internalization.

In a next experiment, the cells were stimulated with CCL1 at EC80 to activate β-arrestin signaling, and inventive antibodies or prior art antibodies were added to evaluate their ability to block activated β-arrestin signaling. Surprisingly, β-arrestin signaling was blocked by both prior art antibodies L263G8 and 433H, while inventive antibody TP-23411 showed no significant effect on β-arrestin signaling, at least up to a concentration of 100 nM (FIG. 26).

TABLE 10.4.1.1

IC50 values for inhibition of CCL1 induced β-arrestin signaling of TPP-23411 and prior art antibodies L263G8 and 433H measured in nM. Staining was performed on CHO cells stably expressing human CCR8 tagged with ProLink. No IC50 could be determined for the inventive antibody, suggesting that TPP-23411 does not block CCL1 induced β-arrestin signaling.

| | TPP-23411 | L263G8 | 433H |
|---|---|---|---|
| CHO with hCCR8: IC50 in nM | N/A | 13.84 | 0.78 |

Example 10.4.2: Phospho ELISA

Figure 29:
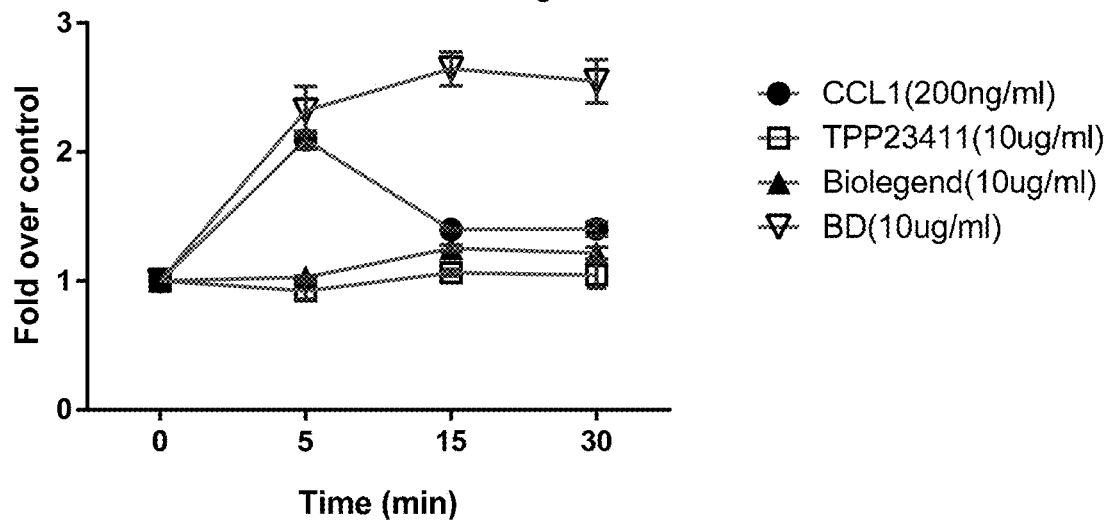
FIG. 29: Phospho AKT ELISA assay. CHO cells expressing human CCR8 were treated with CCL1, TPP-23411, Biolegend L263G8 or BD antibody 433H and cell lysates were collected at the respective time point.

Phospho AKT signaling promotes survival and growth, while phospho Erk1/2 signaling regulates a variety of cellular responses. Phospho Erk1/2 and phospho AKT antibodies were purchased from CellSignaling and ELISA assays were performed according to the manufacturers protocol. CHO cells expressing human CCR8 or activated human Tregs were treated with CCL1, TPP-23411, Biolegend L263G8 or BD antibody 433H, or remained untreated for the negative control. CCL1 served as positive control. Interestingly, prior art antibodies Biolegend L263G8 and BD antibody 433H both induced a significant increase of phosphorylated Erk1/2 levels (FIG. 27, 28) as well as phosphorylated AKT levels (FIG. 29, 30), e.g. after 15 minutes in activated human Tregs, while this was not the case for inventive antibodies. In summary, both prior art antibodies are agonistic for G protein independent pathways, such as AKT phosphorylation or ERK1/2 phosphorylation.

Example 10.4.3: Calcium Flux Assay

Measurement of intracellular calcium mobilization is a robust assay that can be performed in a high-throughput manner to study the effect of compounds or antibodies on potential drug targets such as CCR8. To this end, the activity of receptors that signal through release of Ca2+ can be monitored using the fluorescence-based FLIPR calcium assay (Molecular Devices, Sunnyvale, Calif.). In brief, CHO cells expressing human CCR8 were seeded into assay plates and incubated overnight. Cells were then loaded with Ca+ sensitive dye BUV396/496.

For the measurement of antagonistic function, monitoring of Ca flux signal via FLIPR Tera started in parallel to the addition of antibodies or reference compound (MC148) at different concentrations to the cells. After 1 min incubation of the cells with the antibodies or reference compound, CCL1 agonist was added and calcium flux signal was recorded for an additional 3 min via FLIPR Tetra. To measure agonistic function, antibodies/reference compound were added in parallel to monitoring Ca flux signal via FLIPR for 3 min.

Tables 10.4.3.1 to 10.4.3.4 show results of the calcium flux assay for anti-murine or anti-human CCR8 antibodies. No IC50 could be determined for TPP-14099 and TPP-21047. IC50 for further inventive antibodies varied. In general, majority of inventive antibodies and also the prior art antibodies efficiently blocked CCL1 induced G protein dependent signaling.

TABLE 10.4.3.1

Ca Flux assay. CHO cells expressing murine CCR8 were used to test the ability of the antibodies to block CCL1 induced G-protein dependent Ca signaling. CCL1 at 40 ng/ml was used for induction. Both TPP-14095 and TPP-14099 bind to mouse CCR8. No agonistic effect on G-protein dependent Ca signaling was observed for the inventive antibodies or the prior art antibodies (data not shown).
Ca Flux Assay using CHO cells expressing murine CCR8

|  | TPP-14095 | TPP-14099 |
|---|---|---|
| IC50 (nM) | 1.65 | N/A |

TABLE 10.4.3.2

Ca Flux assay. CHO cells expressing human CCR8 were used to test the ability of the antibodies to block CCL1 induced G-protein dependent Ca signaling. CCL1 was used at a concentration of 80 ng/ml.

|  | TPP-9809 | TPP-18205 | TPP-18206 | TPP-17577 | TPP-17578 |
|---|---|---|---|---|---|
| IC50 (nM) | N/A | 1.6 | 3 | 93.8 | 4.53 |

TABLE 10.4.3.3

Ca Flux assay. CHO cells expressing human CCR8 were used to test the ability of the antibodies to block CCL1 induced G-protein dependent Ca signaling. CCL1 was used at a concentration of 60 ng/ml.

|  | TPP-9809 | TPP-20955 | TPP-21045 | TPP-21047 | TPP-21360 |
|---|---|---|---|---|---|
| IC50 (nM) | N/A | 0.52 | 0.29 | N/A | 0.50 |

TABLE 10.4.3.4

Ca Flux assay. CHO cells expressing human CCR8 were used to test the ability of the antibodies to block CCL1 induced G-protein dependent Ca signaling. CCL1 was used at a concentration of 60 ng/ml.

|  | TPP-9809 | TPP-20955 | TPP-21360 | TPP-23411 | 443H | L263G8 |
|---|---|---|---|---|---|---|
| Hill Slope | ~−1.815e+046 | ~−0.03928 | −2.208 | −0.8122 | −1.048 | −0.6795 |
| IC50 (nM) | N/A | ~1.02e−025 | 0.417 | 1.22 | 1.3 | 1.26 |
| Span ratio (from max to min) | ~93.49 | ~11357 | 433.9 | 400.1 | 995.9 | 921.2 |

Example 10.5: Internalization of Inventive Antibodies

In order to evaluate internalization of CCR8, imaging technology was used to visualize this process. Specific anti-CCR8 antibodies TPP-21360 and TPP-23411 and the corresponding isotype control antibody TPP-5657 were labelled with a fluorescent dye. Additionally, commercial antibodies L263G8 and 433H as well as the murine antibody SA214G2 were also conjugated to the permanent dye BODIPY. These antibodies were lysine-conjugated with a two to six molar excess of BODIPY® FL dye (ester, D2184, ThermoFisher) at pH 8.3. After the conjugation, the reaction mixture was purified by chromatography (PD10 desalting column 1-2.5 ml; GE Healthcare) to eliminate excess dye and to adjust the pH-value. Afterwards, the protein solution was concentrated (VIVASPIN 500, Fa. Sartorius stedim biotec). Determination of the dye load of the antibody was carried out with a spectrophotometer (NanoDrop) and calculated with the formula D:P=$A_{dye}$ $\varepsilon_{protein}$: $(A_{280}-0,16A_{dye})$ $\varepsilon_{dye}$. The dye load of target-specific antibodies TPP-21360 and TPP-23411 and of the isotype control antibody were shown to be in a similar range (dye load/ab: 4.0 and 4.1). The commercial antibodies elicit dye load/antibody of 3.8 and 3.9. Conjugation might elicit a negative impact on antibody affinity thus testing of conjugated antibodies in a cell binding-assay (FACS) is essential to ensure that the labelling did not alter the binding to CCR8 (CD198) (cf. FIG. 31A, FIG. 32A, FIG. 34A, FIG. 34B). The conjugated antibodies were then ready to use for internalization assays performed with the human CCR8-positive cell line HuT78 and the murine CCR8-positive cell line BW5147.3. Prior to treatment, the CCR8-expressing cell lines ($2\times10^4$/well) were seeded in 100 µl medium in a 96-MTP (CellCarrier Ultra, PerkinElmer). After 18 h incubation at 37° C./5% $CO_2$, medium was changed and labelled antibody was added in various concentrations (2.5, 1 µg/ml; triplicates). The same treatment protocol was applied for the labelled isotype control antibody (negative control). Furthermore, the parental CHO-K1 cell line (CCR8 negative cells) was treated alike serving as counter screen (specificity control). The internalization study with the target-specific antibodies was performed in a kinetic fashion. Images were taken after different time points (0 h, 0.5 h, 2 h, 6 h and 24 h) and internalization efficacy was determined by measuring total internalized fluorescence intensity/cell. The measurement was performed using the Operetta CLS (PerkinElmer) and the data analyses of images were performed with the Harmony high-content analysis software (PerkinElmer).

Figure 31:
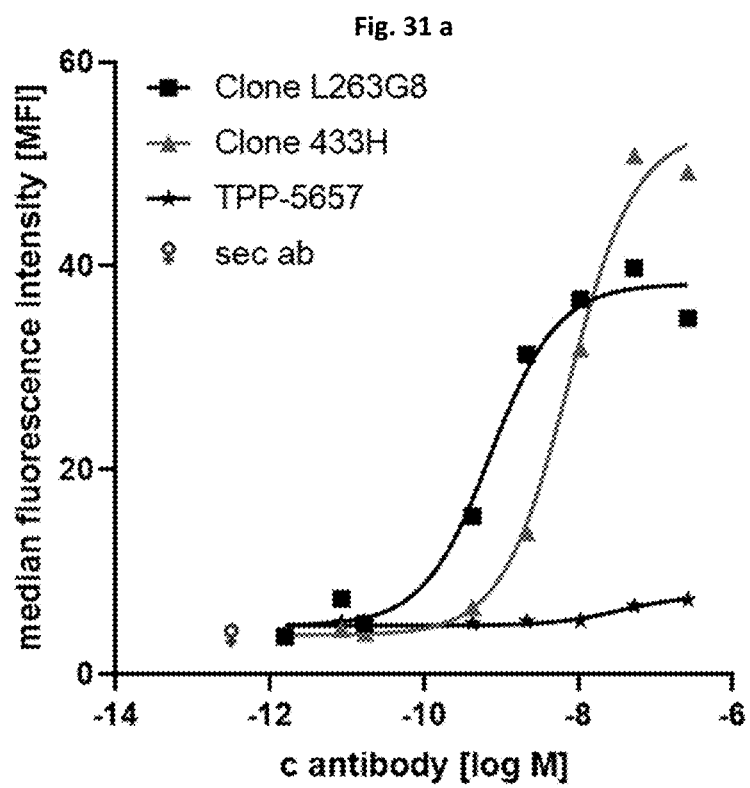
FIG. 31A: Internalization studies. FACS analysis of commercial anti-human CCR8 antibodies Biolegend L263G8 or BD antibody 433H with endogenously CCR8-expressing cell line HuT78.
FIG. 31B: Internalization studies of commercial anti-human CCR8 antibodies with endogenously CCR8-expressing cell line HuT78 based on cytoplasmic-intensity spots. TPP-5657: Isotype control.
Figure 31:
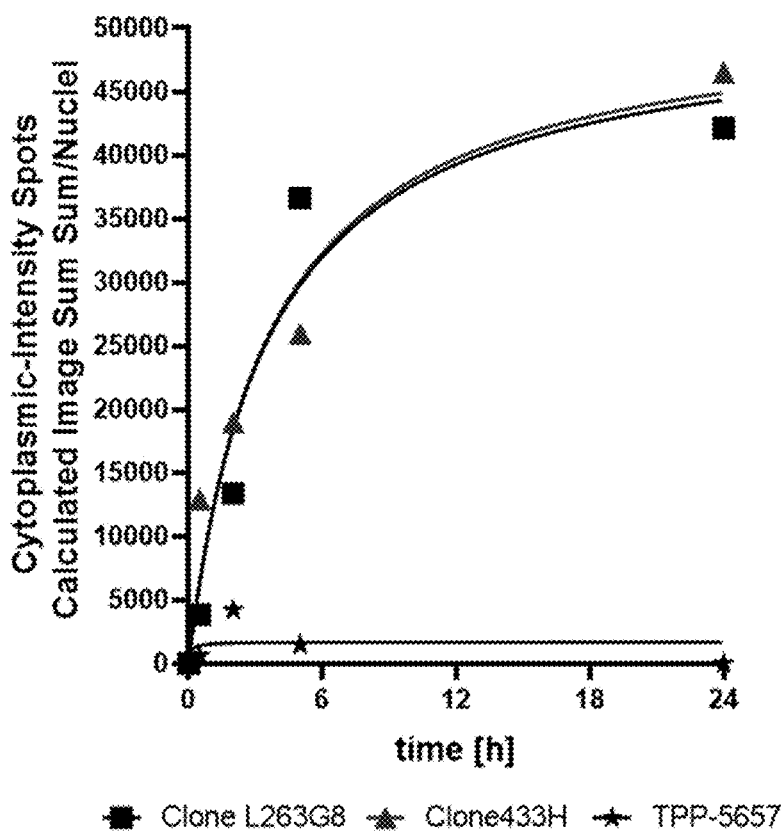
Figure 32:
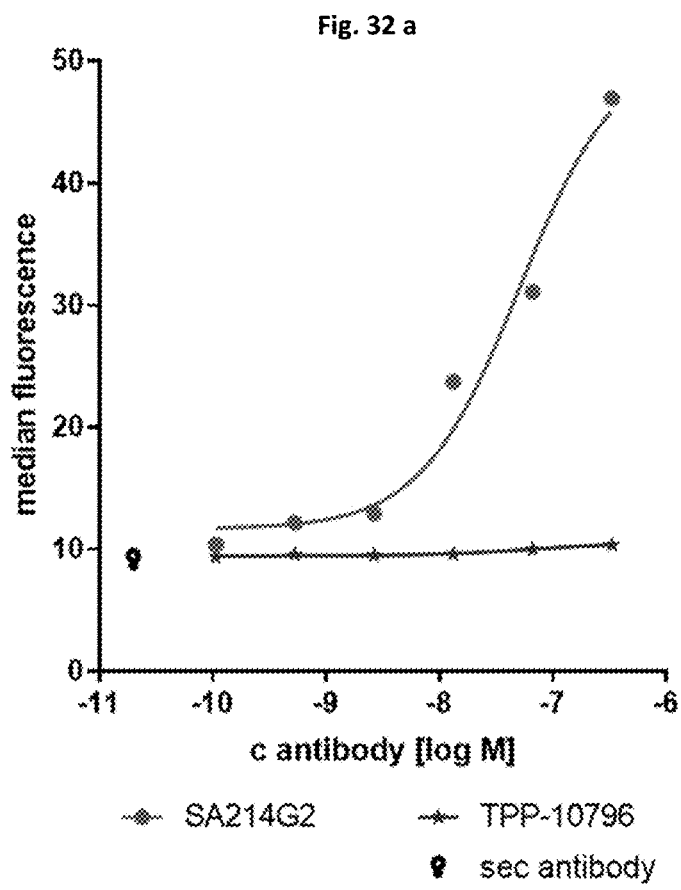
FIG. 32A: Internalization studies. FACS analysis of commercial anti-murine CCR8 antibody SA214G2 with murine endogenously CCR8-expressing cell line BW5147.3.
FIG. 32B: Internalization study of commercial anti-murine CCR8 antibody SA214G2 with murine endogenously CCR8-expressing cell line BW5147.3. The anti-murine CCR8 prior art antibody SA214G2 elicits internalization.
Figure 32:
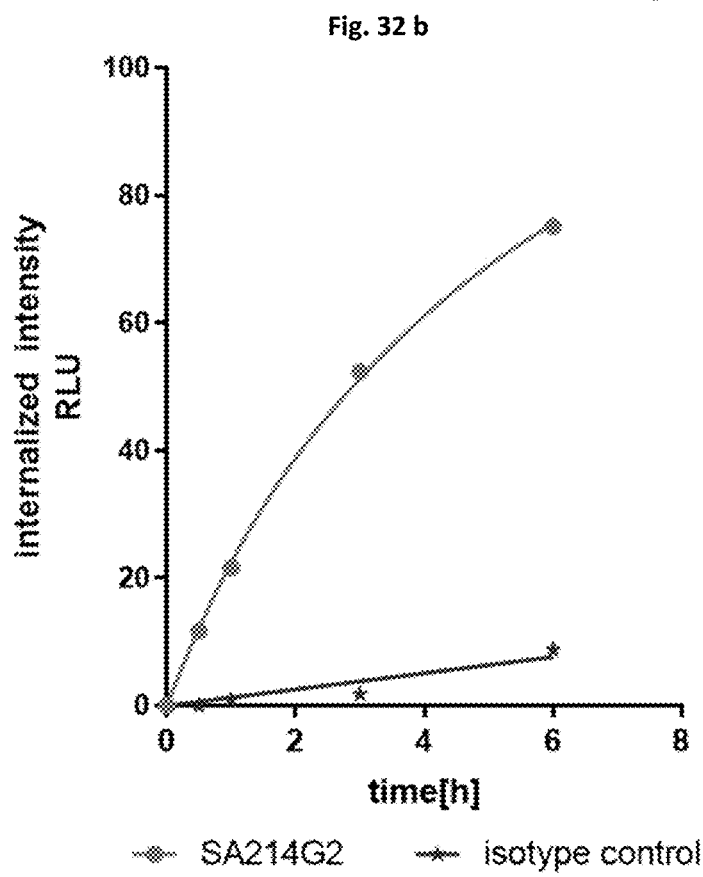
Figure 33:
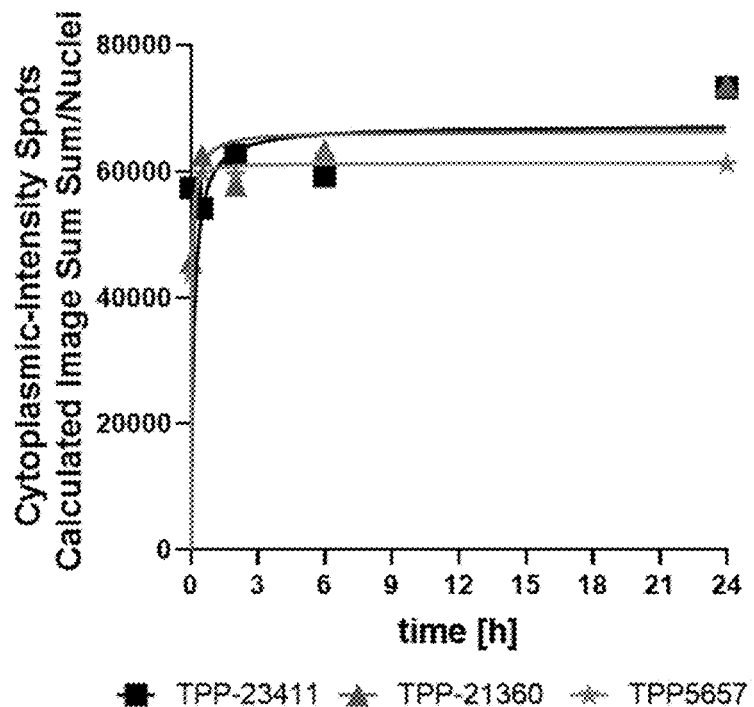
FIG. 33A: Internalization study of inventive anti-human CCR8 antibodies TPP-21360 and TPP-23411 with endogenously CCR8-expressing cell line TALL-1. Both antibodies reveal identical internalization behavior, comparable with the isotype control TPP-5657.
FIG. 33B: Internalization study of inventive anti-human CCR8 antibodies TPP-21360 and TPP-23411 with endogenously CCR8-expressing cell line HuT78. Both antibodies reveal identical internalization behavior, comparable with the isotype control TPP-5657.
Figure 33:
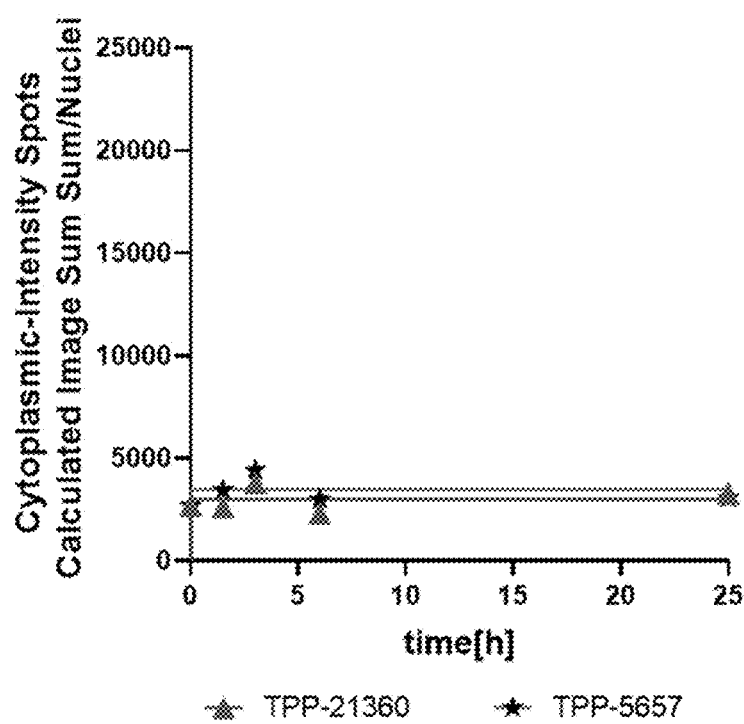
Figure 34:
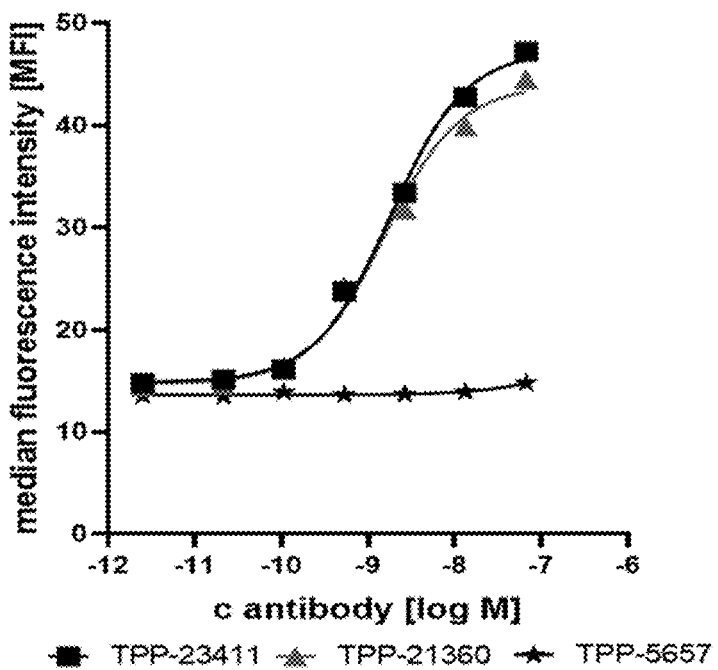
FIG. 34A: FACS analysis of inventive anti-human CCR8 antibodies TPP-21360 and TPP-23411 with endogenously CCR8-expressing cell line TALL-1. Both antibodies reveal same binding potency to the cell line.
FIG. 34B: FACS analysis of inventive anti-human CCR8 antibodies TPP-21360 and TPP-23411 with endogenously CCR8-expressing cell line HuT78. Both antibodies reveal same binding potency to the cell line.
Figure 34:
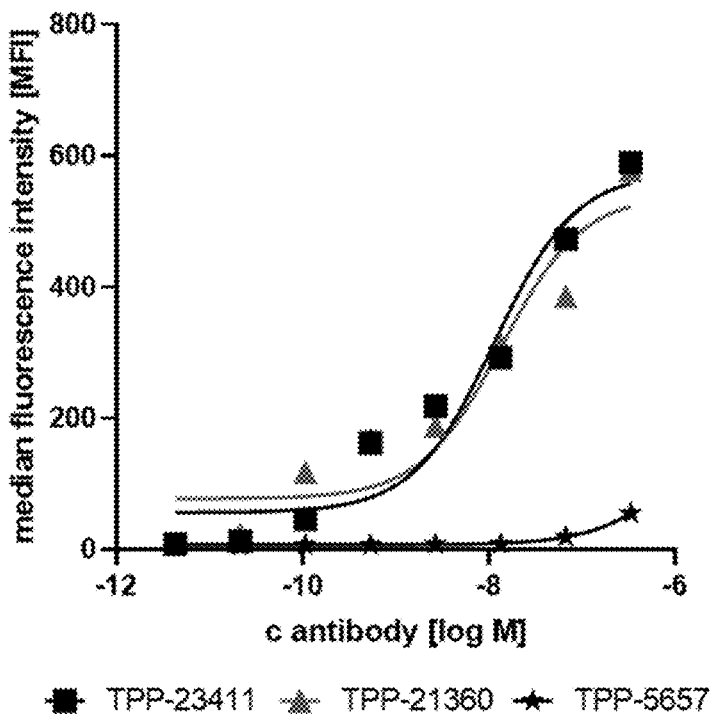

FIGS. 31B and 32B show a substantial internalization of the commercial anti-human CCR8 antibodies 433H and L263G8 in HuT78 cells and commercial anti-murine CCR8 antibody SA214G2 in BW5147.3 cells, while FIG. 33 demonstrates a low or no internalization of the inventive antibodies TPP-21360 and TPP-23411, which is substantially comparable to the isotype control.

TABLE 10.5.1

Summary of internalization data for inventive antibodies and prior art antibodies.

| antibody | FACS HuT78 [MFI] | Internalization [fold isotype] | FACS mBW5147.3 [MFI] | Internalization [fold isotype] |
|---|---|---|---|---|
| TPP-23411 | 600 | 0 | n.a. | n.a. |
| TPP-21360 | 600 | 0 | n.a. | n.a. |
| 433H | 50 | 22 | n.a. | n.a. |
| L263G8 | 40 | 22 | n.a. | n.a. |
| SA214G2 (murine) | n.a. | n.a. | 48 | 11 | n.a: not tested.

Figure 89:
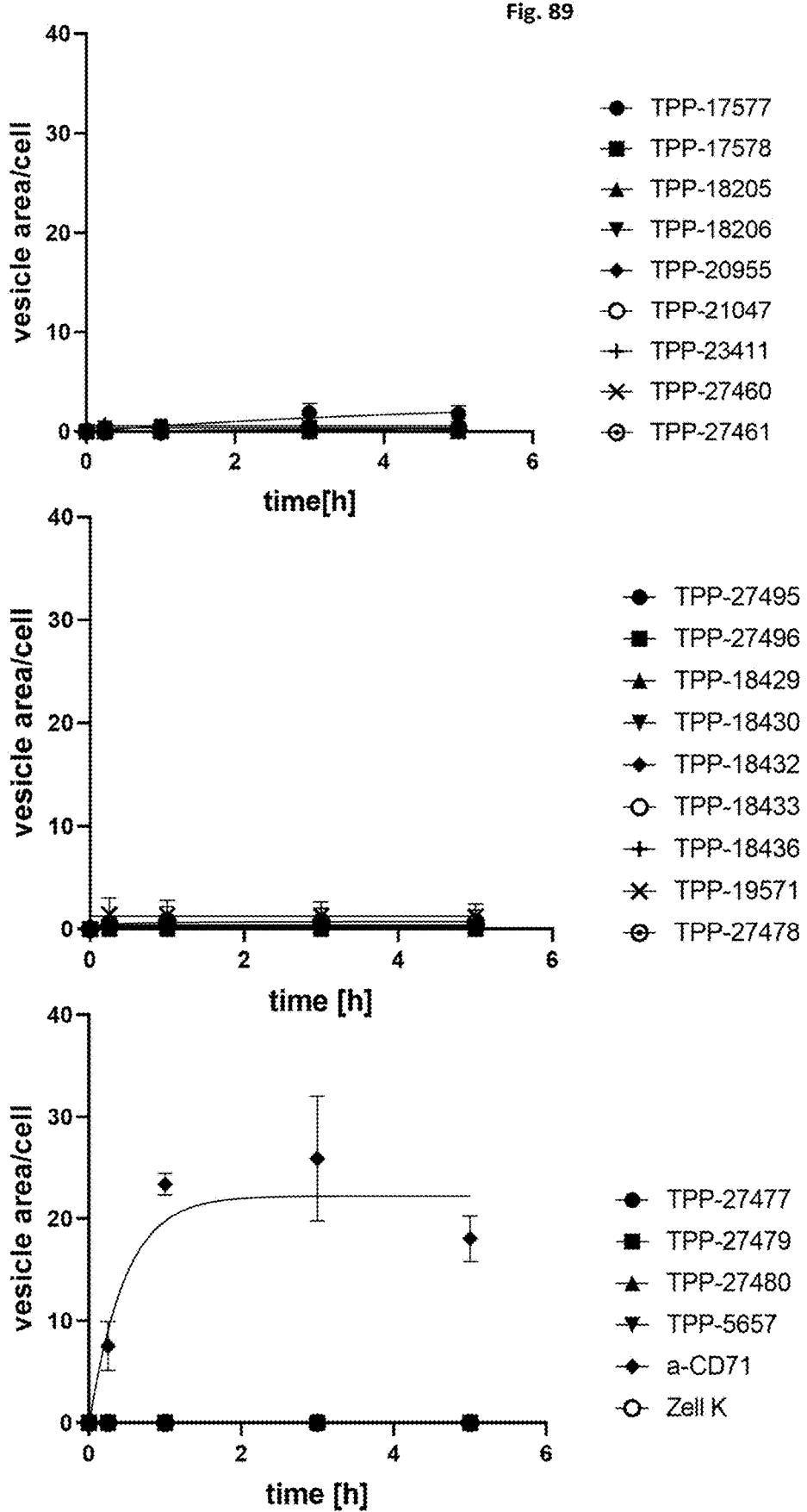
FIG. 89: Internalization curves for various inventive anti-CCR8 antibodies in HUVEC cells. An anti-CD71 antibody with known internalization profile was used as positive control. Corresponding data are shown in Table 10.5.2. None of the antibodies obtained with a method according to the current invention showed substantial internalization, making them particularly useful for ADCC/ADCP based approaches.

To confirm that the low internalization was indeed a feature characterizing all inventive anti-CCR8 antibodies obtained with a sulfated peptide antigen as described herein, the inventive antibodies listed in Table 10.5.2 (see also FIG. 89) were analyzed with respect to their internalization behavior with vesicle area/cell as readout. An anti-CD71 antibody with known substantial internalization was used as positive control. Indeed, all tested inventive anti-human CCR8 antibodies were non-internalizing antibodies, i.e. antibodies showing no substantial degree of internalization. Interestingly, TPP-17577, the only tested human anti human anti-CCR8 antibody without histidine within the HCDR3 showed a somewhat higher internalization than all tested human anti human anti-CCR8 antibody comprising histidine within the HCDR3.

TABLE 10.5.2

Summary of internalization data for inventive antibodies.

| | Internalization HuT78 | Internalization HUVEC |
|---|---|---|
| TPP-17577 | n.a. | none |
| TPP-17578 | n.a. | none |
| TPP-18205 | n.a. | none |
| TPP-18206 | n.a. | none |
| TPP-20955 | none | none |
| TPP-21047 | none | none |
| TPP-23411 | none | none |
| TPP-27495 | none | none |
| TPP-27496 | none | none |
| TPP-18429 | none | none |
| TPP-18430 | none | none |
| TPP-18432 | n.a. | none |
| TPP-18433 | n.a. | none |
| TPP-18436 | none | none |
| TPP-19571 | n.a. | none |
| TPP-27478 | none | none |
| TPP-27477 | none | n.a. |
| TPP-27479 | none | none |
| TPP-27480 | none | none | n.a: not tested.

Example 10.6.1: FcRn Affinity Chromatography of Anti-CCR8 Antibodies

The neonatal Fc receptor (FcRn) is linked to the regulation of metabolic processing of IgG antibodies in vivo. Binding to FcRn in acidic environment of endosomes of vascular endothelial cells protects IgGs from lysosomal degradation. Release of IgGs from FcRn into the blood stream occurs at physiological pH 7.4. Thus, FcRn binds to IgGs at pH<6.5 and has no binding at physiological pH 7.4 Interaction between IgGs and FcRn has an impact on the pharmacokinetics of IgGs in vivo. Characterization of pH dependent IgG binding to FcRn by mimicking the antibody recycling interaction via immobilized FcRn can reveal IgG properties that contribute to their pharmacokinetics.

FcRn affinity runs were performed on an Äkta Pure 25 chromatography system at 25° C. A FcRn column (Roche, Order No. 8128057001; prepacked with approximately 1 mL resin; binding capacity: ≥100 µg IgG) was equilibrated with running buffer A: 20 mM MES/HCl pH 5.5 140 mM NaCl. 30 µL of each antibody (1 mg/mL in equilibration buffer) was applied to the column. Linear pH gradient was generated via increasing the percent of running buffer B 20 mM Tris/HCl pH 8.8 140 mM NaCl as followed: 0 min—20% B, 10 min—20% B, 80 min—100% B, 90 min—100% B, 93 min—20% B, 103 min—20% B. Flow rate was 0.5 mL/min. pH value at point of elution was monitored and read from chromatograms generated with Unicorn 7.1.

As can be seen from Table 10.6.1.1, prior art antibody Ustekinumab served as control for standard pharmacokinetics and prior art antibody Briakinumab served as a control for rapid pharmacokinetics (cf. Schoch, Angela, et al. "Charge-mediated influence of the antibody variable domain on FcRn-dependent pharmacokinetics." Proceedings of the National Academy of Sciences 112.19 (2015): 5997-6002.). TPP-17577, TPP-18205, TPP-27495, TPP-21047 and TPP-27496 show an elution pH greater than pH 7.5 and can be considered to show binding to FcRn also at pH 7.4 to pH 7.5. The measured pH may be used to predict the clearance and half-life of an antibody.

TABLE 10.6.1.1

FcRn affinity chromatography for different antibodies: pH at elution. Two pH values indicate a double peak.

| TPP Nr. | pH at Elution |
|---|---|
| Ustekinumab | 7.22 |
| 27478 | 7.25 |
| 27477 | 7.25 |
| 19571 | 7.25 |
| 23411 | 7.38 |
| 20955 | 7.38 |
| 18436 | 7.38 |
| 18432 | 7.38 |
| 27479 | 7.43 |
| 23480 | 7.5 |
| 18433 | 7.5 |
| 18430 | 7.5 |
| 18429 | 7.5 |
| 18206 | 7.5 |
| 17578 | 7.5 |
| 17577 | 7.50/7.69 |
| 18205 | 7.50/7.77 |

TABLE 10.6.1.1-continued

FcRn affinity chromatography for different antibodies: pH at elution. Two pH values indicate a double peak.

| TPP Nr. | pH at Elution |
|---|---|
| Briakinumab | 7.85 |
| 27495 | 7.88 |
| 21047 | 8 |
| 27496 | 8.13 |

Example 10.6.2: FcRn Binding Analysis Based on SPR

To assess the binding affinity of anti-CCR8 antibodies to FcRn, the binding was investigated using SPR at pH 6.0 and pH 7.4. Binding assays were performed on a Biacore T200 instrument at 25° C. with a CM5 sensor chip and assay buffer PBST. For FcRn binding assays, human, mouse or cynomolgus FcRn were amine-coupled to the CM5 sensor chip surface (~300 RU) and IgGs were injected at concentrations ranging from 15.6-2.000 nM in PBST, pH 6. Regeneration was performed with PBST pH 7.4. In another experiment at pH 7.4 only, IgGs were tested with one concentration of 2 µM, thus it was only qualitatively assessed if a binding occurs. KD values were derived from a steady state affinity analysis as well as from kinetic analysis by fitting to a 1:1 binding isotherm.

As can be seen from Table 10.6.2.1, and as discussed before, Ustekinumab served as positive control and Briakinumab as negative control as published in Schoch et al, 2015. These two antibodies do not significantly differ in their affinity to FcRn, but in their binding response to FcRn at pH 7.4. Thus, it can be assumed that antibodies showing a binding response at pH 7.4 might have an accelerated half-life in vivo.

Example 10.7: Heparin Affinity Chromatography of Anti-CCR8 Antibodies

For the inventive antibodies recognizing human CCR8, charge-mediated interaction is highly likely, because the antibodies recognize a charged antigen tyrosine motif and have a certain structural composition, e.g. with regards to their HCDR3. Charge mediated interactions are however a driving force to degradation of IgGs besides FcRn binding at pH 7.4. Binding to a negatively charged glycocalyx of monocytes or macrophages may lead to pinocytosis and subsequent proteolytic degradation. Kraft et al. showed that antibody behavior in vivo can be predicted more efficiently and accurately when conducting heparine affinity chromatography together with FcRn chromatography (Kraft, Thomas E., et al. "Heparin chromatography as an in vitro predictor for antibody clearance rate through pinocytosis." MAbs. Vol. 12. No. 1. Taylor & Francis, 2020.).

TABLE 10.6.2.1

SPR analysis of affinities of inventive antibodies for different FCRN receptors. Small binding response is defined as a response <30 RU, binding response as >30 RU.

| Antibody | Ligand: FcRn | Binding at pH 6.0 [KD in M] | Binding at pH 7.4 [KD in M] | Ligand: FcRn | Binding at pH 6.0 [KD in M] | Binding at pH 7.4 [KD in M] | Ligand: FcRn | Binding at pH 6.0 [KD in M] | Binding at pH 7.4 [KD in M] |
|---|---|---|---|---|---|---|---|---|---|
| TPP-27496 | human | 1.4E–08 | binding response | cyno | 8.9E–09 | binding response | mouse | 1.6E–08 | binding response |
| TPP-27495 | human | 2.9E–08 | binding response | cyno | 3.0E–08 | binding response | mouse | 3.3E–08 | binding response |
| TPP-27480 | human | 6.1E–08 | binding response | cyno | 6.2E–08 | binding response | mouse | 1.2E–07 | binding response |
| TPP-27479 | human | 8.3E–08 | binding response | cyno | 9.0E–08 | binding response | mouse | 5.0E–08 | binding response |
| TPP-27478 | human | 9.7E07 | No response | cyno | 8.5E–07 | No response | mouse | 1.3E–07 | No response |
| TPP-27477 | human | 1.1E–06 | small/no binding response | cyno | 1.0E–06 | small/no binding response | mouse | 1.7E–07 | small/no binding response |

TABLE 10.6.2.1-continued

SPR analysis of affinities of inventive antibodies for different FCRN receptors. Small binding response is defined as a response <30 RU, binding response as >30 RU.

| Antibody | Ligand: FcRn | Binding at pH 6.0 [KD in M] | Binding at pH 7.4 [KD in M] | Ligand: FcRn | Binding at pH 6.0 [KD in M] | Binding at pH 7.4 [KD in M] | Ligand: FcRn | Binding at pH 6.0 [KD in M] | Binding at pH 7.4 [KD in M] |
|---|---|---|---|---|---|---|---|---|---|
| Ustekinumab | human | 2.0E−07 | No response | cyno | 2.6E−07 | No response | mouse | 7.1E−08 | small binding response |
| Briakinumab | human | 2.3E−07 | binding response | cyno | 1.6E−07 | binding response | mouse | 5.6E−07 | binding response |
| TPP-21047 | human | 6.5E−08 | small binding response | cyno | 4.0E−08 | small binding response | mouse | 1.7E−07 | small binding response |
| TPP-18436 | human | 5.7E−08 | binding response | cyno | 5.3E−08 | binding response | mouse | 3.3E−08 | binding response |
| TPP-18433 | human | 5.8E−08 | binding response | cyno | 5.4E−08 | binding response | mouse | 4.2E−08 | binding response |
| TPP-18432 | human | 8.0E−08 | binding response | cyno | 8.5E−08 | binding response | mouse | 2.7E−08 | binding response |
| TPP-18430 | human | 7.4E−08 | binding response | cyno | 6.9E−08 | binding response | mouse | 5.2E−08 | binding response |
| TPP-18429 | human | 8.1E−08 | binding response | cyno | 7.6E−08 | binding response | mouse | 6.1E−08 | binding response |
| TPP-18205 | human | 9.6E−08 | No response | cyno | 7.9E−08 | No response | mouse | 1.0E−07 | No response |
| TPP-17577 | human | 5.5E−08 | binding response | cyno | 6.6E−08 | binding response | mouse | 4.3E−08 | binding response |
| TPP-18206 | human | 1.4E−07 | binding response | cyno | 2.7E−07 | binding response | mouse | 2.1E−07 | binding response |
| TPP-17578 | human | 1.0E−07 | small binding response | cyno | 1.3E−07 | small binding response | mouse | 3.8E−08 | small binding response |
| TPP-20955 | human | 5.4E−08 | small binding response | cyno | 4.0E−08 | small binding response | mouse | 5.8E−08 | small binding response |
| TPP-23411 | human | 5.1E−08 | small binding response | cyno | 7.0E−08 | small binding response | mouse | | |
| TPP-9809 | human | 1.4E−07 | No response | cyno | 4.0E−07 | No response | mouse | 2.8E−08 | No response |
| TPP-9809 | human | 1.6E−07 | No response | cyno | 4.1E−07 | No response | mouse | 3.9E−08 | No response |
| TPP-19571 | human | 1.3E−06 | small binding response | cyno | 1.2E−06 | small binding response | mouse | 1.9E−07 | binding response |

High affinity, high level of interaction and therefore high retention times may predict a shorter half-life of the tested antibodies. Heparine affinity runs were performed on an Äkta Pure 25 chromatography system at 25° C. A heparane column (Tosoh) was equilibrated with running buffer A: 50 mM TRIS, pH 7.4. 50 µL of each antibody (1 mg/mL in 20 mM Histidin pH 5.5) was applied to the column. A linear salt gradient was generated by increasing the percent of running buffer B 20 mM Tris pH 7.4 1M NaCl as followed: 2 min post injection—0% B, 0-55% B over 16.5 minutes, 100% over 0.5 minutes, 100% B for four minutes. Flow rate was 0.8 mL/min. Time of elution was monitored and read from chromatograms generated with Unicorn 7.1. As can be seen from Table 10.7.1, and as discussed before, Ustekinumab served as positive control and Briakinumab as negative control. Most tested inventive antibodies center around a retention time of 15 to 18 min. Thus, these antibodies might show a reduced half-life if electrostatic interactions contribute in vivo.

TABLE 10.7.1

Heparine affinity chromatography for different antibodies: pH at elution.

| TPP-Nr. | Retention time (minutes) |
|---|---|
| Ustekinumab | 11.95 |
| TPP-17578 | 13.53 |
| TPP-23411 (afuco) | 15.02 |
| TPP-27478 | 15.05 |
| TPP-27495 | 15.29 |
| TPP-19571 | 15.29 |
| TPP-27496 | 15.34 |
| TPP-27477 | 15.35 |
| Briakinumab | 15.78 |
| TPP-23411 (wt) | 15.86 |
| TPP-18205 | 16.02 |
| TPP-21047 | 16.06 |
| TPP-27480 | 16.09 |
| TPP-18436 | 16.21 |
| TPP-20955 | 16.73 |
| TPP-18432 | 17.01 |
| TPP-18206 | 17.24 |

TABLE 10.7.1-continued

Heparine affinity chromatography for different antibodies: pH at elution.

| TPP-Nr. | Retention time (minutes) |
|---|---|
| TPP-18206 | 17.51 |
| TPP-18430 | 17.54 |
| TPP-18429 | 17.54 |
| TPP-18433 | 17.56 |
| TPP-17577 | 18.06 |

| | N | Mean log2 CCR8 expression | SD log2 CCR8 expression | T-test p-value compared to isotype |
|---|---|---|---|---|
| Isotype | 2 | 7.386 | 0.128 | — |
| TPP-23411 | 2 | 5.459 | 0.346 | 0.0537 |

Example 11: Therapeutic Applicability of the Target

For therapeutic use of a certain target in immune oncology, the specific expression of a target is of utmost importance for minimizing systemic side effects. The target shall be specific for the target tissue or cells, e.g. for intra-tumoral Tregs and shall not be expressed on healthy tissues. Furthermore, increased expression of the target in a certain tumor tissue may point towards the medical use for that indication. For example, CCR8 is also expressed on B cell lymphoma and T cell lymphoma tumor cell lines.

Systemic removal of Treg cells may evoke and enhance not only tumor immunity, but also autoimmunity as evidenced by patients suffering from Immune dysregulation-polyendocrinopathy-enteropathy-X-linked (IPEX) syndrome. In this disease, patients lack Tregs due to a genetic alteration and die within the first 2 years of life due to systemic autoimmunity if not treated with appropriate immunosuppression. The high specificity of a target aimed at removal or suppression of intra-tumoral Tregs is thus assumed to be very important to avoid side effects of a therapeutic antibody, such as those observed for CCR4 targeting antibodies.

Example 11.1: Specificity of the Target CCR8

Figure 35:
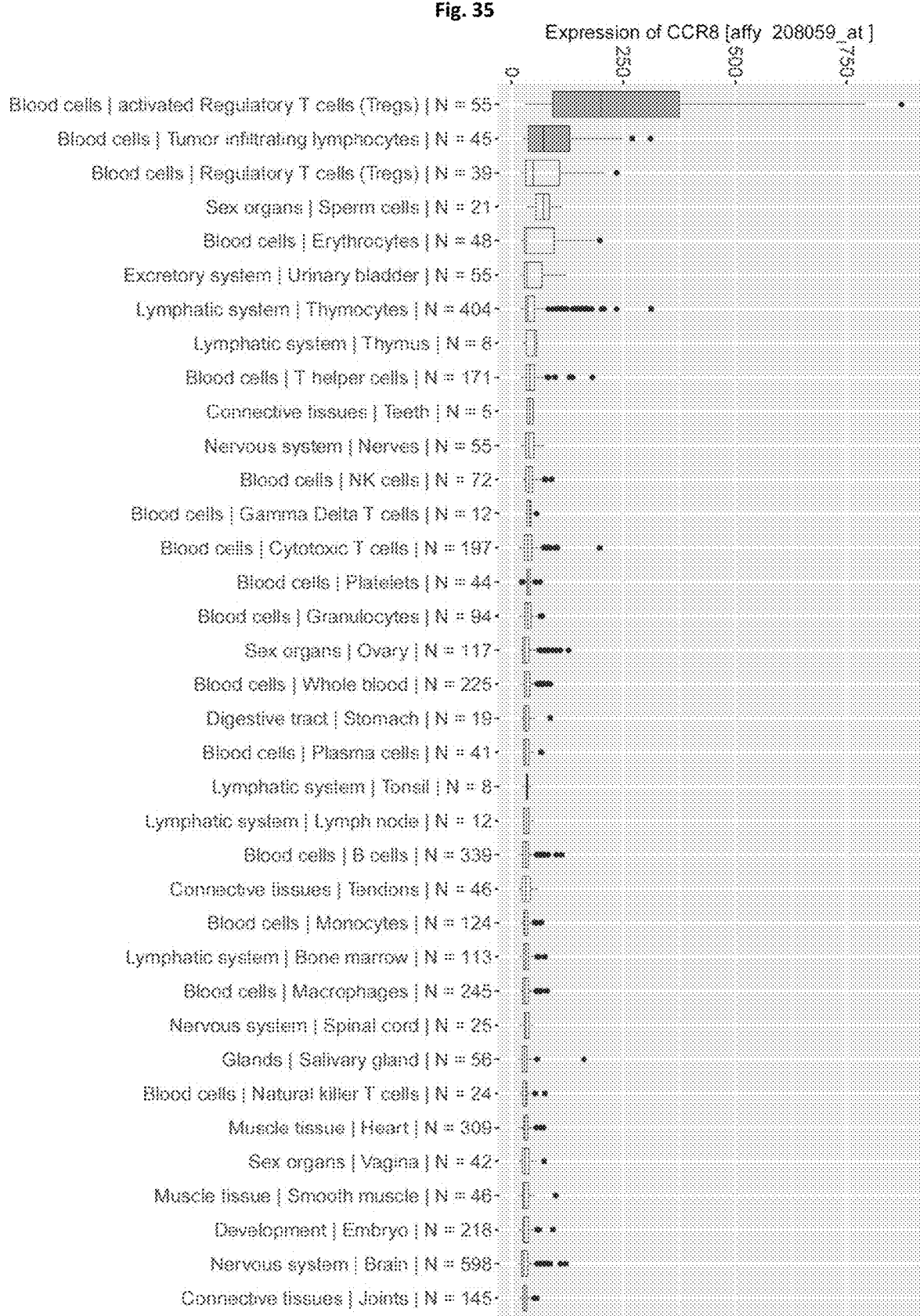
FIG. 35: CCR8 mRNA expression across 11642 samples representing a comprehensive set of human tissues and cell types as measured by affymetrix probe 208059_at. All samples were co-normalized using the refRMA method (Katz, Simon, et al. "A summarization approach for Affymetrix GeneChip data using a reference training set from a large, biologically diverse database." BMC bioinformatics 7.1 (2006): 1-11.). Dark grey box coloring indicates that the median sample in the corresponding group has a probe signal intensity significantly above background noise (as estimated by affymetrix' MASS algorithm, cf. Pepper, Stuart D., et al. "The utility of MASS expression summary and detection call algorithms." BMC bioinformatics 8.1 (2007): 1-12.). Median CCR8 expression significantly above background noise is only observed in activated regulatory T cells as well as tumor infiltrating lymphocytes. Groups are sorted based on decreasing mean expression.
Figure 35:
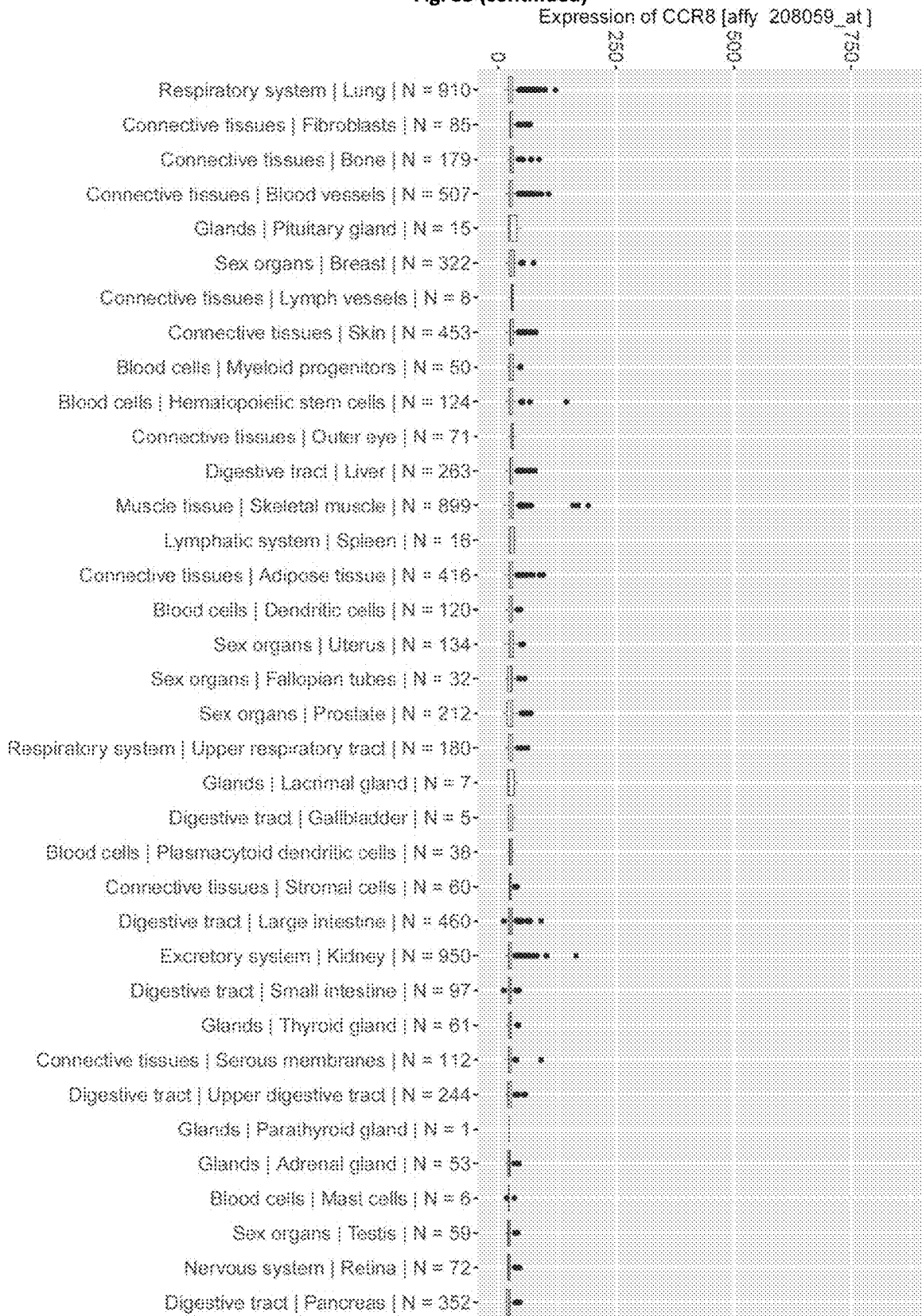

In a first analysis, the inventors evaluated the expression of CCR8 mRNA in different human tissues and cell types. Significant expression of CCR8 mRNA was only observed in activated regulatory T cells, as well as tumor infiltrating lymphocytes (FIG. 35).

Figure 36:
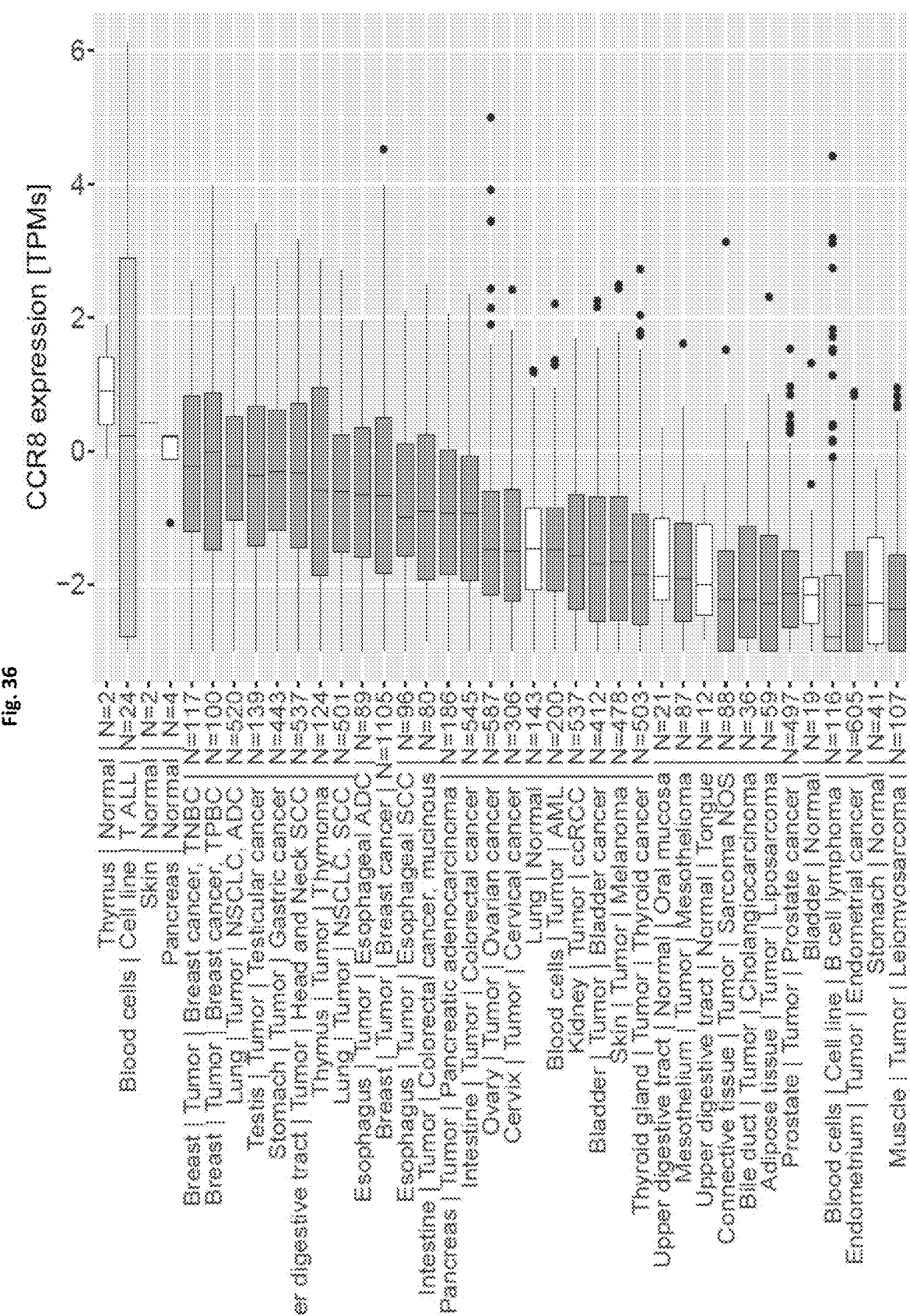
FIG. 36: CCR8 mRNA expression, as measured by RNA-seq, across 50 different TCGA (www.cancer.gov/tcga) tumor indications (dark grey boxes), corresponding normal tissues (white boxes), as well as across the CCLE tumor cell line panel (Barretina, Jordi, et al. "The Cancer Cell Line Encyclopedia enables predictive modelling of anticancer drug sensitivity." Nature 483.7391 (2012): 603-607.) also grouped by tumor indications (light grey boxes). Groups are sorted based on mean expression. Indications with highest CCR8 expression are breast cancer, lung adenocarcinoma (ADC) and squamous cell carcinoma (SCC), head and neck malignancies, as well as esophageal tumors. In all indications except pancreatic adenocarcinoma and melanoma, expression appears higher in the tumor compared to the corresponding normal tissue. Little to no expression is observed in corresponding tumor cell lines of epithelial origin indicating that CCR8 is not expressed by tumor cells but exclusively by tumor infiltrating T cells. In principle, each tumor indication with CCR8+ Treg cell infiltration is supposed to be eligible for anti-CCR8 antibody treatment.

In a second analysis, the inventors evaluated the CCR8 mRNA expression in 50 different tumor indications. Indications with highest CCR8 expression are e.g. breast cancer, lung adenocarcinoma (ADC), testis cancer, stomach cancer and squamous cell carcinoma (SCC), head and neck malignancies as well as esophageal tumors, but high expression was also found in colorectal cancer, ovarian cancer and cervical cancer. In all indications except pancreatic adenocarcinoma and melanoma, expression was found to be higher in the tumor compared to the corresponding normal tissue (FIG. 36).

In a third analysis, the inventors evaluated the co-expression of CCR8 mRNA with FOXP3 mRNA in various tumor indications. Co-expression with Treg marker FOXP3 is important to demonstrate that CCR8 is indeed mainly expressed on Tregs, cf. Table 11.1.1. IHC stainings confirmed these findings, see FIG. 37.

TABLE 11.1.1

CCR8 and the regulatory T cell defining marker FOXP3 are the most closely correlated genes across all 9588 TCGA tumor samples (excluding Thymoma as indication) pointing towards these genes being co-expressed in the same cell type. The table shows the 25 genes (out of 35021 genes) most strongly correlated with CCR8 and FOXP3 mRNA expression levels and their respective Pearson correlation coefficients, r.

| CCR8 | | FOXP3 | |
|---|---|---|---|
| CCR8 | 1.000 | FOXP3 | 1.000 |
| FOXP3 | 0.828 | CCR8 | 0.828 |
| ICOS | 0.814 | ICOS | 0.821 |

TABLE 11.1.1-continued

CCR8 and the regulatory T cell defining marker FOXP3 are the most closely correlated genes across all 9588 TCGA tumor samples (excluding Thymoma as indication) pointing towards these genes being co-expressed in the same cell type. The table shows the 25 genes (out of 35021 genes) most strongly correlated with CCR8 and FOXP3 mRNA expression levels and their respective Pearson correlation coefficients, r.

| CCR8 | | FOXP3 | |
|---|---|---|---|
| CCR4 | 0.813 | TIGIT | 0.804 |
| TIGIT | 0.762 | CTLA4 | 0.766 |
| P2RY10 | 0.760 | SIRPG | 0.747 |
| CD80 | 0.748 | SLAMF1 | 0.741 |
| TNFRSF9 | 0.746 | CCR4 | 0.737 |
| CD3G | 0.741 | IL2RB | 0.737 |
| SLAMF1 | 0.726 | CD5 | 0.733 |
| IL7R | 0.724 | P2RY10 | 0.727 |
| IL2RB | 0.716 | CD3G | 0.724 |
| CTLA4 | 0.715 | TNFRSF9 | 0.723 |
| CD5 | 0.713 | CXCL9 | 0.721 |
| ITK | 0.713 | CD2 | 0.720 |
| IL2RA | 0.711 | GBP5 | 0.718 |
| LAX1 | 0.707 | UBASH3A | 0.714 |
| IKZF3 | 0.699 | CD3E | 0.713 |
| GBP5 | 0.699 | CXCR6 | 0.713 |
| CXCR6 | 0.693 | CXCR3 | 0.712 |
| SIRPG | 0.690 | LTA | 0.712 |
| CD2 | 0.689 | CD80 | 0.710 |
| CSF2RB | 0.688 | CD6 | 0.708 |
| SLAMF7 | 0.683 | ITK | 0.706 |
| CXCL9 | 0.681 | CXCL13 | 0.704 |

In addition, the correlation of CCR8 mRNA with pan-T cell marker CD3, cytotoxic T cell marker CD8, macrophage marker MS4A7, general inflammation marker IFNg, and B cell markers CD19, CD20, CD22 was evaluated for 50 tumor indications, cf. Table 11.1.2. Interestingly, for nearly all indications, the correlation was highly significant, suggesting increased expression of CCR8 upon immune cell infiltration into the tumor per se, and T reg infiltration in particular. From this it can be expected that immune cell infiltration and in particular T cell infiltration are likewise valuable biomarkers for patient stratification to identify patients which are more likely to profit from anti-CCR8 therapy.

TABLE 11.1.2

Pearson correlation coefficients, r, between log2 mRNA levels of CCR8 and Treg marker FOXP3, pan-T cell marker CD3, cytotoxic T cell marker CD8, macrophage marker MS4A7, general inflammation marker IFNg, or B cell markers CD19, CD20, CD22. Results suggest a highly significant co-expression of CCR8 with immune cell and in particular T reg infiltration into tumors across 48 out of 50 indications from TCGA. It can therefore be expected that e.g. T cell infiltration constitutes a valuable stratification biomarker for identifying patients likely profiting from anti-CCR8 therapy.

| Indication | N | regulatory T cells (FOXP3) | | pan T cells (CD3E + CD3D + CD3G) | | cytotoxic T cells (CD8A + CD8B) | |
|---|---|---|---|---|---|---|---|
| | | r | pv | r | pv | r | pv |
| Head and Neck cancer - Oral cancer-SCC | 79 | 0.916 | 1.87E−83 | 0.791 | 1.22E−45 | 0.661 | 2.51E−27 |
| Breast cancer - ADC-Ductal-TPBC | 150 | 0.641 | 1.70E−09 | 0.584 | 8.82E−08 | 0.448 | 8.80E−05 |
| Head and Neck cancer - Laryngeal cancer-SCC | 276 | 0.928 | 1.51E−36 | 0.717 | 2.42E−14 | 0.576 | 1.20E−08 |
| Lung cancer - NSCLC-ADC-Mixed | 132 | 0.901 | 3.77E−40 | 0.763 | 9.07E−22 | 0.580 | 4.79E−11 |
| Breast cancer - ADC-Ductal-TNBC | 197 | 0.870 | 1.30E−31 | 0.729 | 1.13E−17 | 0.602 | 4.20E−11 |
| Gastric cancer - ADC | 165 | 0.853 | 2.87E−45 | 0.747 | 4.64E−29 | 0.677 | 3.04E−22 |
| Lung cancer - NSCLC-ADC | 134 | 0.829 | 4.51E−82 | 0.689 | 2.92E−46 | 0.486 | 2.83E−20 |
| Gastric cancer - ADC-Intestinal | 198 | 0.726 | 1.65E−13 | 0.684 | 1.40E−11 | 0.596 | 1.70E−08 |
| Gastric cancer - ADC-Diffuse | 63 | 0.825 | 2.90E−18 | 0.665 | 4.52E−10 | 0.597 | 6.23E−08 |

TABLE 11.1.2-continued

Pearson correlation coefficients, r, between log2 mRNA levels of CCR8 and Treg marker
FOXP3, pan-T cell marker CD3, cytotoxic T cell marker CD8, macrophage marker MS4A7, general
inflammation marker IFNg, or B cell markers CD19, CD20, CD22. Results suggest a highly significant co-
expression of CCR8 with immune cell and in particular T reg infiltration into tumors across 48 out of 50
indications from TCGA. It can therefore be expected that e.g. T cell infiltration constitutes a valuable
stratification biomarker for identifying patients likely profiting from anti-CCR8 therapy.

| | | | | | | | |
|---|---|---|---|---|---|---|---|
| Testicular cancer - Germ cell tumor-Seminoma | 619 | 0.328 | 4.35E−03 | 0.367 | 1.32E−03 | 0.255 | 2.85E−02 |
| Lung cancer - NSCLC-SCC | 99 | 0.895 | 2.21E−168 | 0.775 | 1.43E−96 | 0.589 | 6.11E−46 |
| Thymoma | 71 | 0.351 | 8.31E−05 | 0.372 | 2.81E−05 | 0.357 | 6.14E−05 |
| Esophageal cancer - ADC | 177 | 0.909 | 9.69E−35 | 0.780 | 2.17E−19 | 0.697 | 3.21E−14 |
| Breast cancer - ADC-Ductal | 336 | 0.783 | 4.02E−129 | 0.675 | 1.58E−83 | 0.570 | 1.28E−54 |
| Gastric cancer - ADC-Intestinal-Tubular | 89 | 0.895 | 1.11E−27 | 0.812 | 5.44E−19 | 0.594 | 1.57E−08 |
| Breast cancer - ADC-Lobular | 96 | 0.848 | 3.26E−50 | 0.730 | 9.15E−31 | 0.642 | 5.98E−22 |
| Pancreatic cancer - ADC-Ductal | 156 | 0.864 | 5.89E−45 | 0.697 | 1.14E−22 | 0.621 | 4.96E−17 |
| Colorectal cancer - ADC | 69 | 0.902 | 7.12E−124 | 0.703 | 2.54E−51 | 0.513 | 6.34E−24 |
| Esophageal cancer - SCC | 75 | 0.832 | 7.93E−26 | 0.653 | 5.31E−13 | 0.578 | 7.03E−10 |
| Head and Neck cancer - SCC | 76 | 0.836 | 7.80E−53 | 0.548 | 7.42E−17 | 0.435 | 1.68E−10 |
| Breast cancer - ADC | 83 | 0.781 | 4.14E−14 | 0.687 | 5.12E−10 | 0.549 | 3.20E−06 |
| Uterine cancer - Cervical-SCC-Non-keratinizing | 207 | 0.809 | 1.19E−27 | 0.536 | 7.66E−10 | 0.368 | 5.71E−05 |
| Uterine cancer - Cervical-SCC-Keratinizing | 197 | 0.853 | 1.29E−16 | 0.637 | 1.75E−07 | 0.595 | 1.70E−06 |
| Bladder cancer - Transitional cell carcinoma | 534 | 0.828 | 7.54E−71 | 0.680 | 7.75E−39 | 0.501 | 5.68E−19 |
| Ovarian cancer - ADC-Cystadenocarcinoma-Papillary serous | 66 | 0.545 | 4.22E−25 | 0.491 | 4.53E−20 | 0.381 | 5.07E−12 |
| Uterine cancer - Cervical-SCC | 127 | 0.804 | 3.16E−20 | 0.681 | 1.02E−12 | 0.644 | 3.76E−11 |
| Kidney cancer - ccRCC | 77 | 0.835 | 5.60E−140 | 0.655 | 8.13E−67 | 0.553 | 4.86E−44 |
| Skin cancer - Melanoma | 86 | 0.797 | 5.44E−105 | 0.798 | 1.66E−105 | 0.721 | 7.80E−77 |
| Thyroid cancer - Papillary carcinoma-Classical variant | 356 | 0.829 | 3.81E−93 | 0.610 | 2.53E−38 | 0.365 | 7.48E−13 |
| Mesothelioma - Epithelioid | 319 | 0.843 | 1.98E−16 | 0.760 | 7.00E−12 | 0.691 | 2.65E−09 |
| Sarcoma - Malignant fibrous histiocytoma | 108 | 0.828 | 6.76E−14 | 0.621 | 1.15E−06 | 0.569 | 1.31E−05 |
| Prostate cancer - ADC-Acinar type | 477 | 0.773 | 7.89E−97 | 0.708 | 1.88E−74 | 0.559 | 5.85E−41 |
| Bladder cancer - Transitional cell carcinoma-Papillary | 57 | 0.889 | 6.39E−46 | 0.743 | 1.97E−24 | 0.662 | 5.43E−18 |
| Uterine cancer - Endometrial-ADC-Endometrioid | 307 | 0.686 | 2.58E−16 | 0.498 | 4.11E−08 | 0.381 | 4.82E−05 |
| Uterine cancer - Endometrial-ADC-Papillary serous | 147 | 0.405 | 1.60E−03 | 0.381 | 3.15E−03 | 0.301 | 2.17E−02 |
| Sarcoma - Liposarcoma-Dedifferentiated | 482 | 0.799 | 5.61E−14 | 0.649 | 3.66E−08 | 0.560 | 4.97E−06 |
| Sarcoma - Leiomyosarcoma | 106 | 0.838 | 4.58E−29 | 0.754 | 1.04E−20 | 0.710 | 1.53E−17 |
| Liver cancer - HCC | 58 | 0.405 | 1.77E−15 | 0.674 | 1.52E−48 | 0.558 | 1.64E−30 |
| Thyroid cancer - Follicular carcinoma | 51 | 0.398 | 3.47E−05 | 0.251 | 1.08E−02 | 0.041 | 6.80E−01 |
| Brain cancer - Glioma-Astrocytoma-Glioblastoma | 472 | 0.616 | 1.34E−18 | 0.612 | 2.31E−18 | 0.492 | 1.86E−11 |
| Kidney cancer - Papillary-Type II | 74 | 0.755 | 4.86E−17 | 0.688 | 2.38E−13 | 0.648 | 1.54E−11 |
| Kidney cancer - Papillary | 120 | 0.858 | 4.77E−38 | 0.618 | 1.04E−14 | 0.618 | 9.58E−15 |
| Uterine cancer - Endometrial-Carcinosarcoma-Malignant mixed mullerian tumor | 102 | 0.716 | 3.73E−10 | 0.573 | 3.20E−06 | 0.378 | 3.79E−03 |
| Kidney cancer - Papillary-Type I | 363 | 0.781 | 5.15E−17 | 0.460 | 2.58E−05 | 0.482 | 9.16E−06 |
| Kidney cancer - Chromophobe | 84 | 0.227 | 6.63E−02 | 0.179 | 1.50E−01 | 0.177 | 1.55E−01 |
| Adrenal cancer - Adrenocortical carcinoma | 55 | 0.176 | 1.21E−01 | 0.363 | 1.01E−03 | 0.333 | 2.72E−03 |
| Adrenal cancer - Pheochromocytoma | 114 | 0.455 | 4.92E−09 | 0.377 | 1.99E−06 | 0.340 | 2.09E−05 |
| Brain cancer - Glioma-Astrocytoma | 108 | 0.620 | 2.70E−22 | 0.541 | 2.29E−16 | 0.473 | 2.32E−12 |
| Brain cancer - Glioma-Oligoastrocytoma | 58 | 0.479 | 4.70E−09 | 0.553 | 4.19E−12 | 0.427 | 2.70E−07 |
| Brain cancer - Glioma-Oligodendroglioma | 57 | 0.217 | 2.11E−03 | 0.295 | 2.46E−05 | 0.236 | 7.98E−04 |

TABLE 11.1.2-continued

Pearson correlation coefficients, r, between log2 mRNA levels of CCR8 and Treg marker FOXP3, pan-T cell marker CD3, cytotoxic T cell marker CD8, macrophage marker MS4A7, general inflammation marker IFNg, or B cell markers CD19, CD20, CD22. Results suggest a highly significant co-expression of CCR8 with immune cell and in particular T reg infiltration into tumors across 48 out of 50 indications from TCGA. It can therefore be expected that e.g. T cell infiltration constitutes a valuable stratification biomarker for identifying patients likely profiting from anti-CCR8 therapy.

| Indication | N | macrophages (MS4A7) | | M2 macrophages (MRC1) | | Inflammation (IFNg) | | B cells (CD19 + MS4A1 + CD22) | |
|---|---|---|---|---|---|---|---|---|---|
| | | r | pv | r | pv | r | pv | r | pv |
| Head and Neck cancer - Oral cancer-SCC | 79 | 0.742 | 1.62E−37 | 0.578 | 7.11E−20 | 0.505 | 8.98E−15 | 0.610 | 1.82E−22 |
| Breast cancer - ADC-Ductal-TPBC | 150 | 0.107 | 3.75E−01 | 0.371 | 1.44E−03 | 0.552 | 5.92E−07 | 0.404 | 4.78E−04 |
| Head and Neck cancer - Laryngeal cancer-SCC | 276 | 0.740 | 1.40E−15 | 0.687 | 7.76E−13 | 0.317 | 3.52E−03 | 0.434 | 4.20E−05 |
| Lung cancer - NSCLC-ADC-Mixed | 132 | 0.534 | 2.74E−09 | 0.623 | 5.84E−13 | 0.464 | 4.25E−07 | 0.520 | 7.74E−09 |
| Breast cancer - ADC-Ductal-TNBC | 197 | 0.622 | 6.43E−12 | 0.607 | 2.82E−11 | 0.446 | 3.70E−06 | 0.563 | 1.30E−09 |
| Gastric cancer - ADC | 165 | 0.675 | 4.00E−22 | 0.704 | 1.26E−24 | 0.629 | 1.52E−18 | 0.435 | 1.42E−08 |
| Lung cancer - NSCLC-ADC | 134 | 0.594 | 7.28E−32 | 0.642 | 1.75E−38 | 0.415 | 1.03E−14 | 0.491 | 9.47E−21 |
| Gastric cancer - ADC-Intestinal | 198 | 0.531 | 9.78E−07 | 0.533 | 8.65E−07 | 0.436 | 9.37E−05 | 0.501 | 4.68E−06 |
| Gastric cancer - ADC-Diffuse | 63 | 0.684 | 9.45E−11 | 0.593 | 7.99E−08 | 0.403 | 5.93E−04 | 0.405 | 5.55E−04 |
| Testicular cancer - Germ cell tumor-Seminoma | 619 | −0.040 | 7.37E−01 | 0.429 | 1.35E−04 | 0.203 | 8.20E−02 | 0.035 | 7.67E−01 |
| Lung cancer - NSCLC-SCC | 99 | 0.658 | 2.03E−60 | 0.633 | 8.10E−55 | 0.494 | 1.09E−30 | 0.574 | 4.27E−43 |
| Thymoma | 71 | 0.147 | 1.09E−01 | 0.039 | 6.69E−01 | −0.055 | 5.47E−01 | 0.228 | 1.23E−02 |
| Esophageal cancer - ADC | 177 | 0.713 | 4.46E−15 | 0.719 | 2.23E−15 | 0.598 | 5.98E−10 | 0.662 | 1.61E−12 |
| Breast cancer - ADC-Ductal | 336 | 0.232 | 5.09E−09 | 0.538 | 9.58E−48 | 0.606 | 3.17E−63 | 0.465 | 1.62E−34 |
| Gastric cancer - ADC-Intestinal-Tubular | 89 | 0.703 | 1.44E−12 | 0.743 | 1.50E−14 | 0.603 | 7.94E−09 | 0.596 | 1.38E−08 |
| Breast cancer - ADC-Lobular | 96 | 0.264 | 3.78E−04 | 0.483 | 9.41E−12 | 0.653 | 7.46E−23 | 0.495 | 2.60E−12 |
| Pancreatic cancer - ADC-Ductal | 156 | 0.757 | 1.55E−28 | 0.766 | 1.34E−29 | 0.389 | 1.13E−06 | 0.423 | 9.66E−08 |
| Colorectal cancer - ADC | 69 | 0.752 | 1.72E−62 | 0.770 | 2.78E−67 | 0.436 | 5.18E−17 | 0.479 | 1.09E−20 |
| Esophageal cancer - SCC | 75 | 0.678 | 3.14E−14 | 0.431 | 1.18E−05 | 0.550 | 6.51E−09 | 0.357 | 3.57E−04 |
| Head and Neck cancer - SCC | 76 | 0.594 | 3.86E−20 | 0.516 | 8.40E−15 | 0.424 | 5.27E−10 | 0.381 | 3.41E−08 |
| Breast cancer - ADC | 83 | 0.271 | 3.15E−02 | 0.505 | 2.41E−05 | 0.603 | 1.73E−07 | 0.468 | 1.11E−04 |
| Uterine cancer - Cervical-SCC-Non-keratinizing | 207 | 0.555 | 1.54E−10 | 0.527 | 1.71E−09 | 0.346 | 1.59E−04 | 0.559 | 9.91E−11 |
| Uterine cancer - Cervical-SCC-Keratinizing | 197 | 0.730 | 2.64E−10 | 0.498 | 1.10E−04 | 0.456 | 4.65E−04 | 0.591 | 2.03E−06 |
| Bladder cancer - Transitional cell carcinoma | 534 | 0.509 | 1.36E−19 | 0.590 | 2.75E−27 | 0.427 | 1.14E−13 | 0.409 | 1.53E−12 |
| Ovarian cancer - ADC-Cystadenocarcinoma-Papillary serous | 66 | 0.309 | 3.22E−08 | 0.293 | 1.64E−07 | 0.410 | 7.12E−14 | 0.139 | 1.49E−02 |
| Uterine cancer - Cervical-SCC | 127 | 0.629 | 1.51E−10 | 0.577 | 9.49E−09 | 0.516 | 5.17E−07 | 0.645 | 3.57E−11 |
| Kidney cancer - ccRCC | 77 | 0.520 | 2.71E−38 | 0.245 | 1.04E−08 | 0.577 | 8.41E−49 | 0.476 | 1.71E−31 |
| Skin cancer - Melanoma | 86 | 0.614 | 2.96E−50 | 0.639 | 1.74E−55 | 0.665 | 1.54E−61 | 0.653 | 9.36E−59 |
| Thyroid cancer - Papillary carcinoma-Classical variant | 356 | 0.440 | 1.41E−18 | 0.649 | 7.94E−45 | 0.446 | 3.63E−19 | 0.365 | 7.05E−13 |
| Mesothelioma-Epithelioid | 319 | 0.465 | 2.68E−04 | 0.317 | 1.64E−02 | 0.596 | 9.94E−07 | 0.364 | 5.35E−03 |
| Sarcoma - Malignant fibrous histiocytoma | 108 | 0.160 | 2.63E−01 | 0.125 | 3.84E−01 | 0.527 | 6.99E−05 | 0.524 | 8.03E−05 |
| Prostate cancer - ADC-Acinar type | 477 | 0.594 | 3.24E−47 | 0.596 | 1.25E−47 | 0.528 | 7.01E−36 | 0.595 | 1.78E−47 |
| Bladder cancer - Transitional cell carcinoma-Papillary | 57 | 0.607 | 1.14E−14 | 0.709 | 1.80E−21 | 0.586 | 1.57E−13 | 0.628 | 7.43E−16 |
| Uterine cancer - Endometrial-ADC-Endometrioid | 307 | 0.456 | 7.25E−07 | 0.422 | 5.28E−06 | 0.425 | 4.61E−06 | 0.402 | 1.59E−05 |
| Uterine cancer - Endometrial-ADC-Papillary serous | 147 | 0.369 | 4.36E−03 | 0.347 | 7.66E−03 | 0.122 | 3.61E−01 | 0.044 | 7.43E−01 |
| Sarcoma - Liposarcoma-Dedifferentiated | 482 | 0.206 | 1.21E−01 | 0.118 | 3.79E−01 | 0.482 | 1.26E−04 | 0.526 | 2.25E−05 |
| Sarcoma - Leiomyosarcoma | 106 | 0.569 | 1.97E−10 | 0.558 | 5.09E−10 | 0.674 | 2.30E−15 | 0.491 | 8.84E−08 |
| Liver cancer - HCC | 58 | 0.524 | 1.54E−26 | 0.263 | 5.06E−07 | 0.555 | 3.42E−30 | 0.575 | 1.09E−32 |

TABLE 11.1.2-continued

Pearson correlation coefficients, r, between log2 mRNA levels of CCR8 and Treg marker FOXP3, pan-T cell marker CD3, cytotoxic T cell marker CD8, macrophage marker MS4A7, general inflammation marker IFNg, or B cell markers CD19, CD20, CD22. Results suggest a highly significant co-expression of CCR8 with immune cell and in particular T reg infiltration into tumors across 48 out of 50 indications from TCGA. It can therefore be expected that e.g. T cell infiltration constitutes a valuable stratification biomarker for identifying patients likely profiting from anti-CCR8 therapy.

| Indication | N | r | p | r | p | r | p | r | p |
|---|---|---|---|---|---|---|---|---|---|
| Thyroid cancer - Follicular carcinoma | 51 | 0.243 | 1.39E−02 | 0.334 | 5.99E−04 | 0.110 | 2.69E−01 | 0.171 | 8.61E−02 |
| Brain cancer - Glioma-Astrocytoma-Glioblastoma | 472 | 0.418 | 2.23E−08 | 0.402 | 8.97E−08 | 0.365 | 1.44E−06 | 0.312 | 4.52E−05 |
| Kidney cancer - Papillary-Type II | 74 | 0.443 | 1.91E−05 | 0.510 | 5.24E−07 | 0.575 | 6.83E−09 | 0.451 | 1.33E−05 |
| Kidney cancer - Papillary | 120 | 0.457 | 6.48E−08 | 0.492 | 4.23E−09 | 0.651 | 1.13E−16 | 0.512 | 7.97E−10 |
| Uterine cancer - Endometrial-Carcinosarcoma-Malignant mixed mullerian tumor | 102 | 0.370 | 4.58E−03 | 0.213 | 1.12E−01 | 0.519 | 3.49E−05 | 0.277 | 3.69E−02 |
| Kidney cancer - Papillary-Type I | 363 | 0.206 | 7.19E−02 | 0.252 | 2.70E−02 | 0.609 | 4.04E−09 | 0.527 | 8.67E−07 |
| Kidney cancer - Chromophobe | 84 | 0.326 | 7.52E−03 | 0.262 | 3.36E−02 | 0.246 | 4.68E−02 | 0.165 | 1.86E−01 |
| Adrenal cancer - Adrenocortical carcinoma | 55 | 0.394 | 3.32E−04 | 0.327 | 3.24E−03 | 0.273 | 1.48E−02 | 0.084 | 4.59E−01 |
| Adrenal cancer - Pheochromocytoma | 114 | 0.221 | 6.66E−03 | 0.225 | 5.71E−03 | 0.315 | 8.80E−05 | 0.191 | 1.94E−02 |
| Brain cancer - Glioma-Astrocytoma | 108 | 0.348 | 5.53E−07 | −0.023 | 7.48E−01 | 0.543 | 1.57E−16 | 0.502 | 6.07E−14 |
| Brain cancer - Glioma-Oligoastrocytoma | 58 | 0.212 | 1.40E−02 | 0.133 | 1.26E−01 | 0.627 | 5.05E−16 | 0.214 | 1.30E−02 |
| Brain cancer - Glioma-Oligodendroglioma | 57 | 0.148 | 3.77E−02 | 0.029 | 6.82E−01 | 0.338 | 1.07E−06 | 0.097 | 1.76E−01 |

Example 11.2: Specificity of CCR8 for Intra-Tumoral Tregs Compared with T Effector Cells There are several issues to consider with regards to Treg depletion for cancer immunotherapy in humans. Treg and activated effector T cells most often share the expression of the same types of cell surface molecules, including CD25 and CTLA-4, making it difficult to selectively deplete Tregs without also affecting effector T cells by antibodies specific for these molecules.

Foxp3+CD25+CD4+ Treg cells in tumors (tumor infiltrating or intra-tumoral Tregs) express higher levels of cell surface molecules associated with T-cell activation, such as CD25, CTLA-4, PD-1, LAG3, TIGIT, ICOS, and TNF receptor super family members including 4-1BB, OX-40, and GITR, compared with Tregs in lymphoid or non-lymphoid tissues or the blood. In addition, tumor infiltrating Tregs express high levels of specific chemokine receptors including CCR4 and CCR8.

Figure 38:
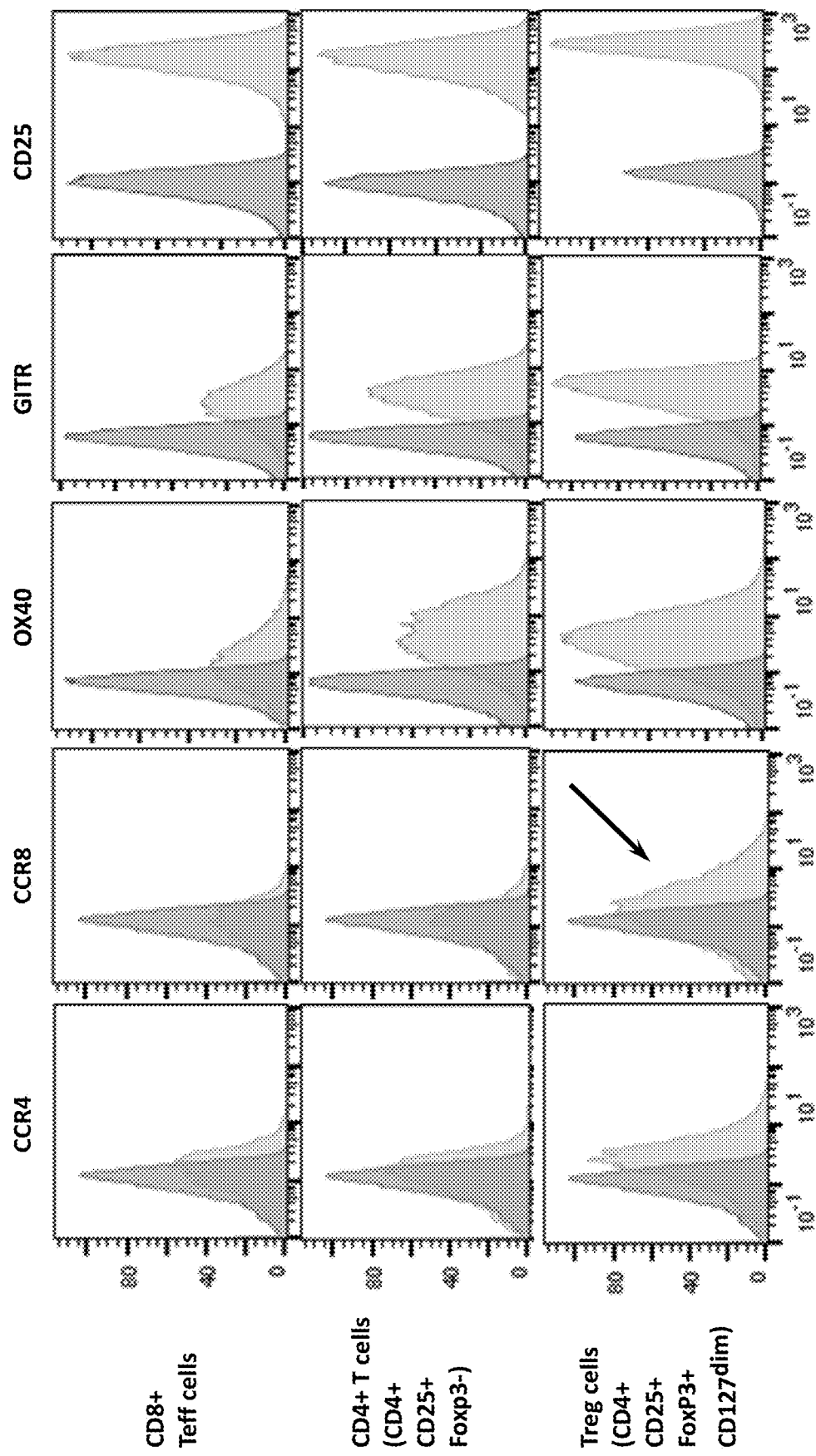
FIG. 38: Staining of FACS sorted T cell populations based on CCR4, CCR8, OX40, GITR, and CD25. Only CCR8 is specific for activated Tregs. OX40, GITR, and CD25 are significantly expressed on stimulated CD8+ Teff cells and CD4+ T cells (CD4+CD25+Foxp3−). Dark grey: isotype control, light grey: target staining.

CD4+CD25+ sorted and unsorted PBMCs were activated with anti-CD3 and anti-CD28 beads+IL2 for 6 days. FACS analysis showed CCR8 protein expression preferentially on stimulated Tregs (CD4+CD25+FoxP3+CD127dim), see FIG. 38. Alternative targets OX40, GITR, and CD25 but not CCR8 are significantly expressed on stimulated CD8+ Teff cells and CD4+ T cells (CD4+CD25+Foxp3−). CCR4 shows rather Treg specific expression but no intratumor T reg specificity. These findings are consistent with the observation that CCR4 antibodies have shown immunological side effects, which have been attributed to the systemic depletion of Tregs. In terms of specificity, CCR8 seems to be superior to support the specific depletion of intra-tumoral Tregs.

Figure 39:
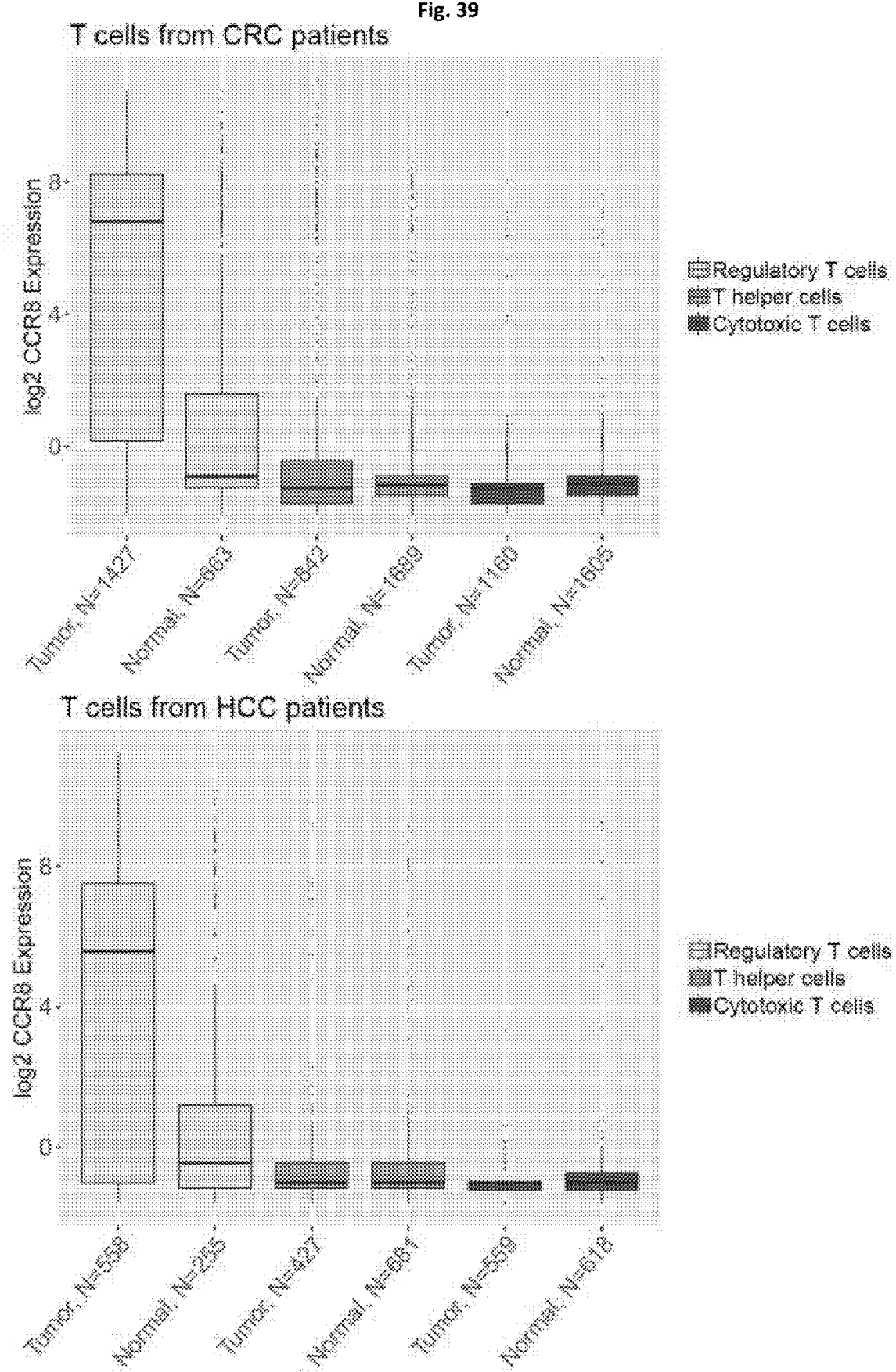
FIG. 39: Expression of CCR8 across different T cell subsets extracted from different tumor entities as measured by single cell RNA-seq. For these tumors, CCR8 mRNA expression is largely restricted to regulatory T cells (light grey boxes) residing in tumor tissue while largely being absent in regulatory T cells from normal tissues as well as from CD4 helper T and CD8 cytotoxic T cells (medium and dark gray boxes, respectively). Upper panel: Colorectal tumor tissue (Tumor) or adjacent normal tissue (Normal). Middle panel: Liver cancer tissue (Tumor) or adjacent normal tissue (Normal). Lower panel: Lung cancer tissue (Tumor) or adjacent normal lung tissue and peripheral blood (Normal). Sample sizes, N, indicate the number of cells in each category. Cells were designated as regulatory T cells, T helper cells, or cytotoxic T cells based on expression of marker genes FOXP3, CD4 (but no FOXP3), and CD8A/B, respectively.
Figure 39:
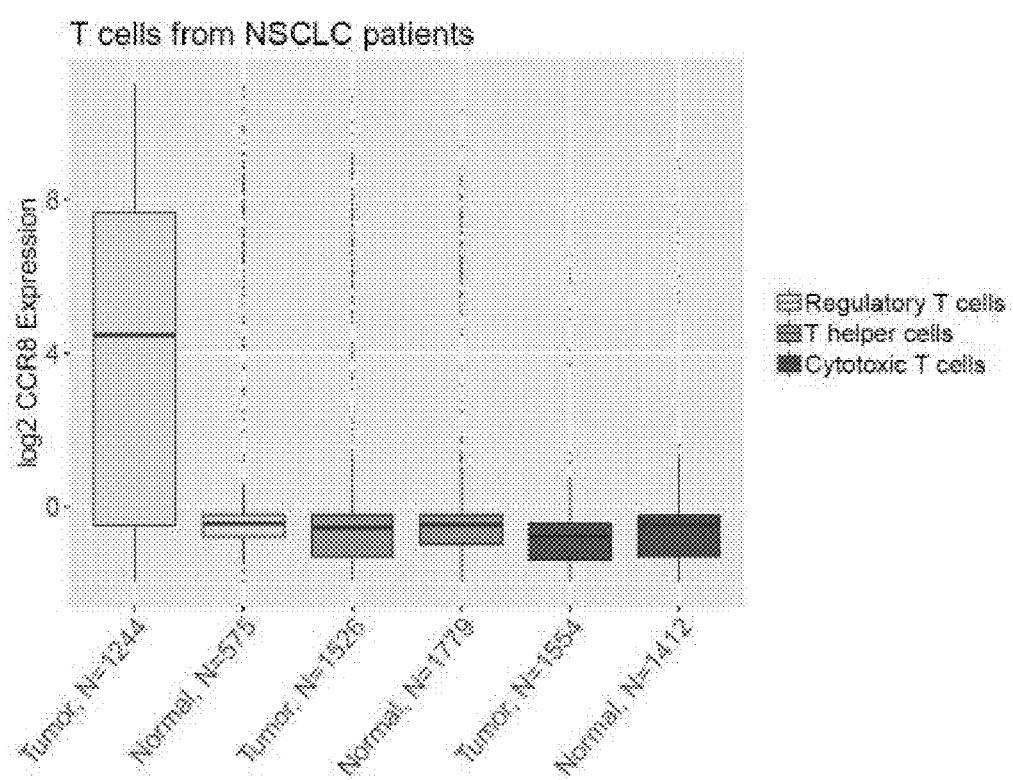

To confirm the findings, raw data for NSCLC, CRC and liver cancer patients were retrieved from Guo, Xinyi, et al. "Global characterization of T cells in non-small-cell lung cancer by single-cell sequencing." Nature medicine 24.7 (2018): 978-985, Zhang, Yuanyuan, et al. "Deep single-cell RNA sequencing data of individual T cells from treatment-naïve colorectal cancer patients." Scientific data 6.1 (2019): 1-15, and Zheng, Chunhong, et al. "Landscape of infiltrating T cells in liver cancer revealed by single-cell sequencing." Cell 169.7 (2017): 1342-1356, respectively and used for analysis of CCR8 specificity, see FIG. 39. Indeed, for these tumors, CCR8 mRNA expression is largely restricted to regulatory T cells (light grey boxes) residing in tumor tissue while largely being absent in regulatory T cells from normal tissues as well as from CD4 helper T and CD8 cytotoxic T cells (medium and dark gray boxes, respectively).

Figure 40:
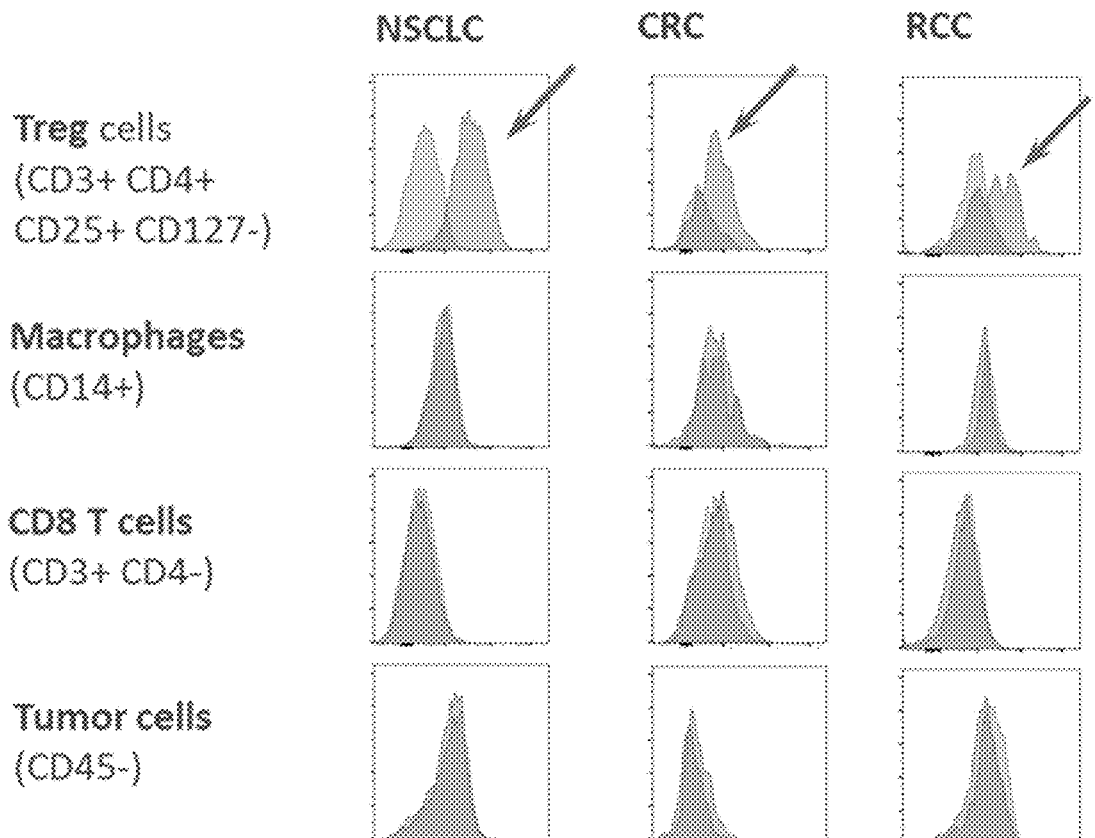
FIG. 40: Treg, macrophage, T cell or tumor cell populations from NSCLC, CRC (colorectal cancer) or RCC (renal carcinoma) were stained with anti-CCR8 antibody or isotype control and were analyzed by flow cytometry. X axis: Log shift up to $10^5$; Y axis: Intensity normalized to mode. Lighter grey: isotype control. Darker grey: CCR8. Specific CCR8 expression on intra-tumoral human Tregs is indicated by arrows.

FACS analysis of human tumor lysate samples confirmed that CCR8 protein is specifically expressed on human tumor-infiltrating Tregs in non-small-cell lung cancer (NSCLC), colorectal carcinoma (CRC), renal cell carcinoma (RCC) and lymph nodes (LNs, data not shown), FIG. 40. Up to 90% of tumor-infiltrated Tregs are CCR8 positive, e.g. in NSCLC, 40-90% in stage III+ and 40-70% in stage I/II, in CRC 20-40% in stage III+, and in RCC 40-50% in stage III+. Based on these data, stratification according to staging is assumed to lead to a further benefit for patients treated with an anti-CCR8 antibody.

Example 12: In Vivo Experiments

Example 12.1.1: Surrogate Antibodies & Syngeneic Tumor Models

In mouse experiments surrogate antibodies binding to mouse-CCR8 were used to demonstrate anti-tumor efficacy and to characterize the mode-of-action, namely Treg depletion within the tumor depending on ADCC (antibody-dependent cellular cytotoxicity) and ADCP (antibody-dependent cellular phagocytosis) potency.

TABLE 12.1.1.1

List of surrogate anti-mouse CCR8 antibodies used for in vivo studies. ADCC was determined using HEK293 cells overexpressing murine CCR8 as target cells and NK92 cells as effector cells. ADCC activity is measured by lactate dehydrogenase (LDH) release.

| Anti-CCR8 antibody | Isotype | ADCC potency in vitro |
|---|---|---|
| TPP-14095 | Human IgG1 | Not determined |
| TPP-14099 | | EC50: 3.14 nM |
| TPP-18208_aglyco | | EC50: >98 nM |
| TPP-18209_aglyco | | Not determined |
| TPP-15285 | Mouse IgG2a | EC50: 0.5 nM |
| TPP-15286 | | Not determined |
| TPP-9809 | Human IgG1 | Non-binding isotype control |
| TPP-10748 | Mouse IgG2a | Non-binding isotype control |
| TPP-15726 | Human IgG1 | Aglycosylated isotype control |

Anti-murine CCR8 antibody TPP-14099 binds CHO cells expressing murine CCR8 with an EC50 of 3 nM and murine iTregs with an EC50 of 13.2 nM, as determined by FACS (data not shown).

Different syngeneic tumor models were used to model tumors with a high degree of immune infiltration as well as tumors with a low degree of immune cell infiltration. Furthermore, the used models deviate in their responses to treatment with known checkpoint-inhibitors, e.g. treatment with anti-CTLA4, anti-PD1 or anti-PD-L1 antibodies. An overview of tested tumor models with the efficacy data for the respective inventive anti-CCR8 antibody is shown in Table 12.1.1.2. Remarkably, efficacy was demonstrated in various syngeneic tumor models.

In brief, a suspension containing usually 500.000-1.000.000 tumor cells per 100 µl PBS, medium or a mixture of 50% Matrigel was subcutaneously injected into the flank of female immunocompetent mice (e.g. Balb/c, C57B16). At palpable tumor sizes of about 60-100 mm$^3$ (usually 100 mm$^3$) CCR8-antibody administration started by intraperitoneal injection of typically 10 mg/kg in a volume of 5-10 ml/kg. In dose-titration studies lower doses were tested. Non-binding antibodies of the respective isotype served as control. Groups comprised n=10 mice. Therapy was applied twice per week, typically as a q3/4d schedule, and tumor size and body weight were measured three times per week. Tumor growth data are plotted as mean volume over time.

Tumor and tissue samples were taken from identically treated satellite animals (n=5 per group) 24 hours after the second antibody treatment and were analyzed by flow cytometry after dissociation into single cells and lysis of erythrocytes with particular focus on changes in absolute numbers of regulatory T cells (Tregs) per 100 mg tissue. Used markers for determining activated Tregs were CD45+CD4+CD25+FoxP3+. Other FACS markers comprised CD8, NKp46, 4-1BB, F4/80, CD11c, Gr1 and MHCII.

TABLE 12.1.1.2

Overview of different tumor models with parameters to characterize treatment outcome. Efficacy was measured by Treg depletion, Overall Response Rate and Tumor-to-Control ratio based on final tumor volumes of anti-CCR8 surrogate antibodies in syngeneic mouse tumor models.

| Model | TPP (10 mg/kg) | Treg depletion (%)[1] | CD8+ T cell/Treg ratio | ORR[2] (% CRs) | T/C vol[3] |
|---|---|---|---|---|---|
| CT26[4] | 14099 | 78.3 | 56 | 58 (30) | 0.15 |
| H22 | | n.d. | n.d. | 0 (0) | 0.30 |
| 4T1 | | n.d. | n.d. | 20 (0) | 0.42 |
| Hepa1-6 | | n.d. | n.d. | 10 (0) | 0.45 |
| C38 | | 45.5 | 17 | 4.5 (0) | 0.55 |
| MC38 | | n.d. | n.d. | 0 (0) | 0.78 |
| LL/c | | n.d. | n.d. | 0 (0) | 0.85 |
| MBT2 | | n.d. | n.d. | 10 (10) | 0.86 |
| RM-1 | | n.d. | n.d. | 0 (0) | 0.99 |
| B16BI6 | | n.d. | n.d. | 0 (0) | 1.06 |
| CT26[4] | 15285 | 82.3 | 64 | 72 (30) | 0.18 |
| EMT-6 | | 61.6 | 3 | 90 (0) | 0.28 |
| F9 | | 73.2 | 54 | 60 (30) | 0.21 |
| C38 | | 68.2 | 16 | 40 (30) | 0.23 |
| B16F10-OVA | | 59.0 | 77 | 0 (0) | 0.37 |
| A20 | | 28.0 | 3 | 40 (30) | 0.46 |
| 4T1 | | 37.1 | 1 | 0 (0) | 0.90 |
| B16F10 | | 7.5 | 3 | 0 (0) | 0.95 |
| EG7-ova | | n.d. | n.d. | 0 (0) | 0.86 |
| PANC02 | | n.d. | n.d. | 10 (0) | 0.51 |
| MBT2 | | n.d. | n.d. | 30 (20) | 0.40 |
| MC38 | | n.d. | n.d. | 30 (0) | 0.35 |
| MC38 | | n.d. | n.d. | 0 (0) | 0.58 |
| J558 | | n.d. | n.d. | 0 (0) | 0.89 |
| RENCA | | n.d. | n.d. | 0 (0) | 0.81 |
| Colon26 | | n.d. | n.d. | 0 (0) | 0.50 |
| KLN205 | | n.d. | n.d. | 0 (0) | 0.79 |

[1]Treg depletion was calculated as percent difference between the intra-tumoral Tregs in the isotype control and the intra-tumoral Tregs in tumors treated with the therapeutic antibody.
[2]Overall response rate (ORR) and Complete response (CR) are based on an adaption of the RECIST criteria to the fast tumor growth in a mouse model (CR: complete responder (<10% of initial tumor volume); PR: partial responder (max 300% of initial tumor volume); NR: non-responder (>300% of initial tumor volume)).
[3]T/C refers to treatment tumor volume/control tumor volume at study end. n.d.: not determined.
[4]Averages of several studies in this tumor model.

For each syngeneic mouse tumor model, 10 tumors in both the isotype control group as well as the anti-CCR8 treatment group were harvested at the end of the treatment cycle, 24 h after last treatment (bi-weekly treatment until tumors in either group reached an average volume of 3000 mm$^3$) and genome wide mRNA expression was measured via RNA-seq. Of 17 models assessed via RNA-seq 13 models showed elevated CD8 mRNA levels in the anti-CCR8 treatment group compared to the control group with fold changes as shown in Table 12.1.1.3. For models CT26, H22, RM1, MBT2, and Hepa1-6 the increase in CD8 levels was significant according to a T-test statistic indicating significant increases in cytotoxic T cells infiltration at end of the treatment cycle. These data strongly suggest that the CD8+ cells were involved in effecting the tumor response.

TABLE 12.1.1.3

Changes in CD8 mRNA levels induced by anti-CCR8 treatment.

| Model | Fold change | T test p-value |
|---|---|---|
| CT26 | 8.604 | 8.7E−08 |
| H22 | 7.160 | 1.7E−09 |
| RM1 | 3.105 | 3.1E−03 |
| MBT2 | 2.716 | 1.3E−09 |
| WEHI-164 | 1.680 | 1.4E−01 |
| Hepa1-6 | 1.621 | 2.7E−02 |
| LL2 | 1.315 | 1.3E−01 |
| PANC02 | 1.242 | 5.4E−01 |
| KLN205 | 1.194 | 5.2E−01 |
| RENCA | 1.188 | 6.7E−01 |

TABLE 12.1.1.3-continued

Changes in CD8 mRNA levels induced by anti-CCR8 treatment.

| Model | Fold change | T test p-value |
|---|---|---|
| Colon26 | 1.137 | 7.6E−01 |
| B16BL6 | 1.022 | 9.3E−01 |
| J558 | 0.924 | 8.6E−01 |
| MC38 | 0.898 | 6.2E−01 |
| 4T1 | 0.499 | 8.8E−02 |
| EG7-OVA | 0.449 | 4.3E−02 |

Example 12.1.2: Syngeneic Model Characterization for Biomarker Identification

Based on genome wide RNA-seq data of early tumors from the syngeneic models, increased levels of the following genes were found to strongly correlate with tumor response: Eif3j2, Eno1b, Ifi441, Hist1h2a1, Ifi202b, Hmga1b, Amd2, Sycp1, Itln1, Trim34b, Catsperg2, Zfp868, Serpina1b, Prss41, Clrb, Cyld, Ccnblip1, Masp2, Acaa1b, C4a, Snord93, Abhd1, Serpina3h, H2-K2, Cd1d2, Hal, Rnf151, Rbm46, Arg2, Mir8099-2, Igsf21, Olfr373, C1s2, Crym, Arv1, Hddc3, Plppr4, Ppplr11, Rps3a2, Zfp459, Rnd1, Serpina1a, Vcpkmt, Atp10d, Gbp2b, H2-T24, Tlcd2, Ctse, H2-Q10, Cyp2c55, Borcs8, Tpsab1, Trim43b, Cc2d1a, Serpina1d, Cacna1a, Kcnj14, Ttc13, Farsa, Olfr1217, Jam1, H2-B1, Tnpo2, Rims3, Dock9, Car5b, Atp1a4, H2-Q1, Zfp69, Slpi, Pcdhgb8, Ocel1, Selenbp2, Nsd3, Wt1, Nap1l2, Ranbp9, Gtpbp3, AY761185, Rnaset2a, Serpina3i, E1l2, Gal3st2b, Urb2, F12, Klk1, Ifi214, Cstl1, Agtpbp1, Msh5, Cox18, Zfp330, Ttc37, Klk4, H2-Q5, Cxcl11, Rab39, Pm20d1, Nod2, H2-DMb2. Interestingly, this set is highly enriched for early complement factors, complement regulating factors such as Serpins, and MHC components. These markers or a combination thereof may be used for stratification or to predict or monitor tumor response. In particular, the presence of high levels of Complement C1/C4 might contribute to Treg lysis. Where depletion/consumption of complement factors reduces the efficacy of Treg depletion, supplementing the complement system, e.g. in a combination treatment may be an option.

The different syngeneic models were further characterized with regards to absolute numbers of immune cell subsets and frequency within total CD45+ immune cells in the tumors. For the models analyzed via flow cytometry (Table 12.1.2.1), B16F10 is characterized by the lowest number of immune cells—and showed the least reduction in tumor volume, cf. Table 12.1.2.1. Thus, immune cell infiltration may be used for stratification to predict response to treatment with CCR8 antibodies. This hypothesis could later be confirmed using B16B16.

TABLE 12.1.2.1

Characterization of tumor microenvironment by absolute numbers of immune cell subsets and frequency within total CD45+ immune cells in the tumors of the vehicle group analyzed at an early timepoint (24 hours after the second treatment). T/C vol describes the ratio of tumor volume of the CCR8-antibody treated group (10 mg/kg twice weekly) versus control group at the end of the study.

Absolute immune cell numbers

| Model | T/C vol | CD45+ | CD8+ | CD4+ conv | Treg | NK cells | Mph |
|---|---|---|---|---|---|---|---|
| CT26 | 0.18 | 1368322 | 192436 | 74946 | 66189 | 271952 | 54108 |
| F9 | 0.21 | 535626 | 19741 | 21068 | 13965 | 50021 | 33206 |
| EMT-6 | 0.28 | 1178255 | 9201 | 26504 | 18767 | 10016 | 290251 |
| B16F10-OVA | 0.37 | 388299 | 80015 | 26337 | 9948 | 68771 | 33597 |
| 4T1 | 0.42 | 399181 | 17992 | 11636 | 32076 | 16386 | 52023 |
| A20 | 0.46 | 548792 | 144609 | 77894 | 80907 | 26629 | 85936 |
| C38 | 0.55 | 525455 | 176380 | 57803 | 37518 | 36523 | 17514 |
| B16F10 | 0.95 | 57459 | 2633 | 3269 | 653 | 6558 | 20057 |

Relative immune cell numbers

| Model | T/C vol[1] | % CD8+ of CD45+ | % CD4+ conv of CD45+ | % Treg of CD45+ | % NK cells of CD45+ | % Mph of CD45+ |
|---|---|---|---|---|---|---|
| CT26 | 0.18 | 14.1 | 5.5 | 4.8 | 19.9 | 4.0 |
| F9 | 0.21 | 3.7 | 3.9 | 2.6 | 9.3 | 6.2 |
| EMT-6 | 0.28 | 0.8 | 2.2 | 1.6 | 0.9 | 24.6 |
| B16F10-OVA | 0.37 | 20.6 | 6.8 | 2.6 | 17.7 | 8.7 |
| 4T1 | 0.42 | 4.5 | 2.9 | 8.0 | 4.1 | 13.0 |
| A20 | 0.46 | 26.4 | 14.2 | 14.7 | 4.9 | 15.7 |
| C38 | 0.55 | 33.6 | 11.0 | 7.1 | 7.0 | 3.3 |
| B16F10 | 0.95 | 4.6 | 5.7 | 1.1 | 11.4 | 34.9 |

Example 12.2: Efficacy in CT26-Tumor Bearing Mice

Figure 41:
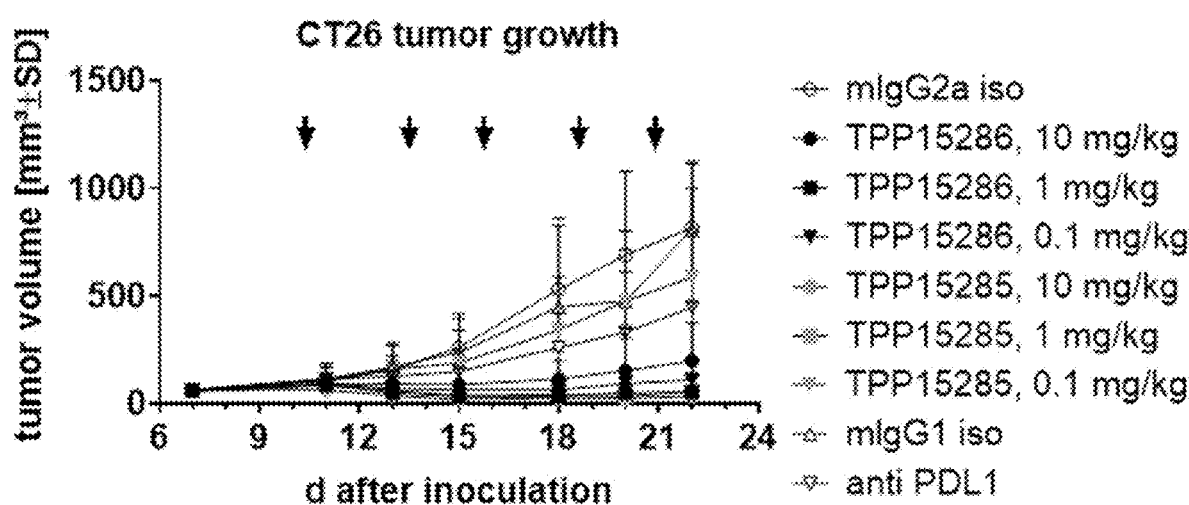
FIG. 41: CT26 tumor growth after treatment with different doses of anti-CCR8 antibodies or anti-PDL1 antibody.

Treatment with anti-CCR8 antibodies TPP-15285 and TPP-15286 showed strong anti-tumor efficacy in CT26 tumor bearing mice (FIG. 41). TPP-15285 showed reduced efficacy at the lowest dose of 0.1 mg/kg, other dose-dependent differences were not significant. As expected, an anti-PD-L1 antibody ("PDL1") demonstrated medium efficacy in the model. Non-binding antibodies of the respective isotypes did not show any efficacy.

Figure 42:
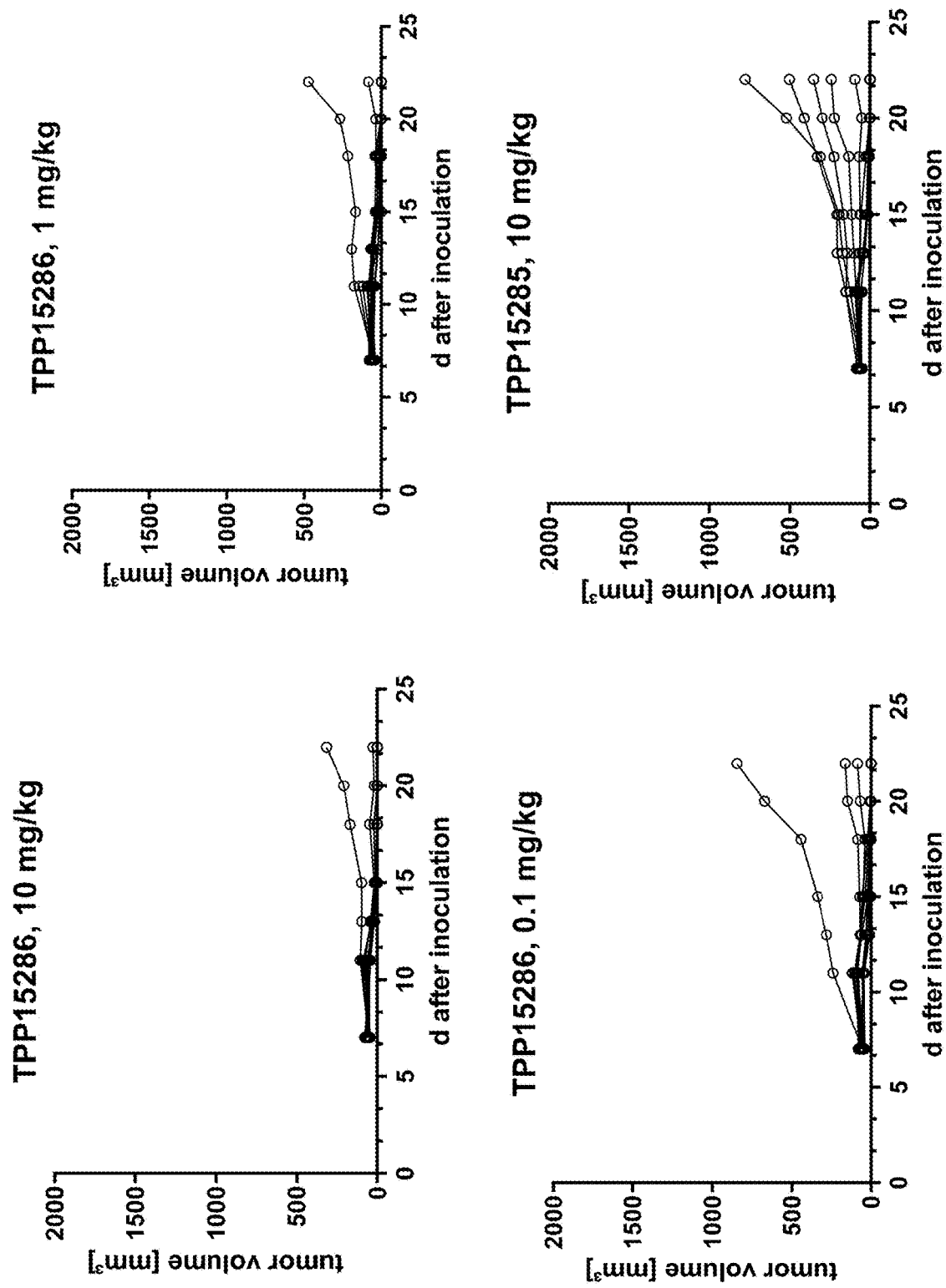
FIG. 42: Spider plots of CT26 tumor bearing mice after treatment with different doses of anti-CCR8 antibodies, anti-PDL1 antibody or isotype controls.
Figure 42:
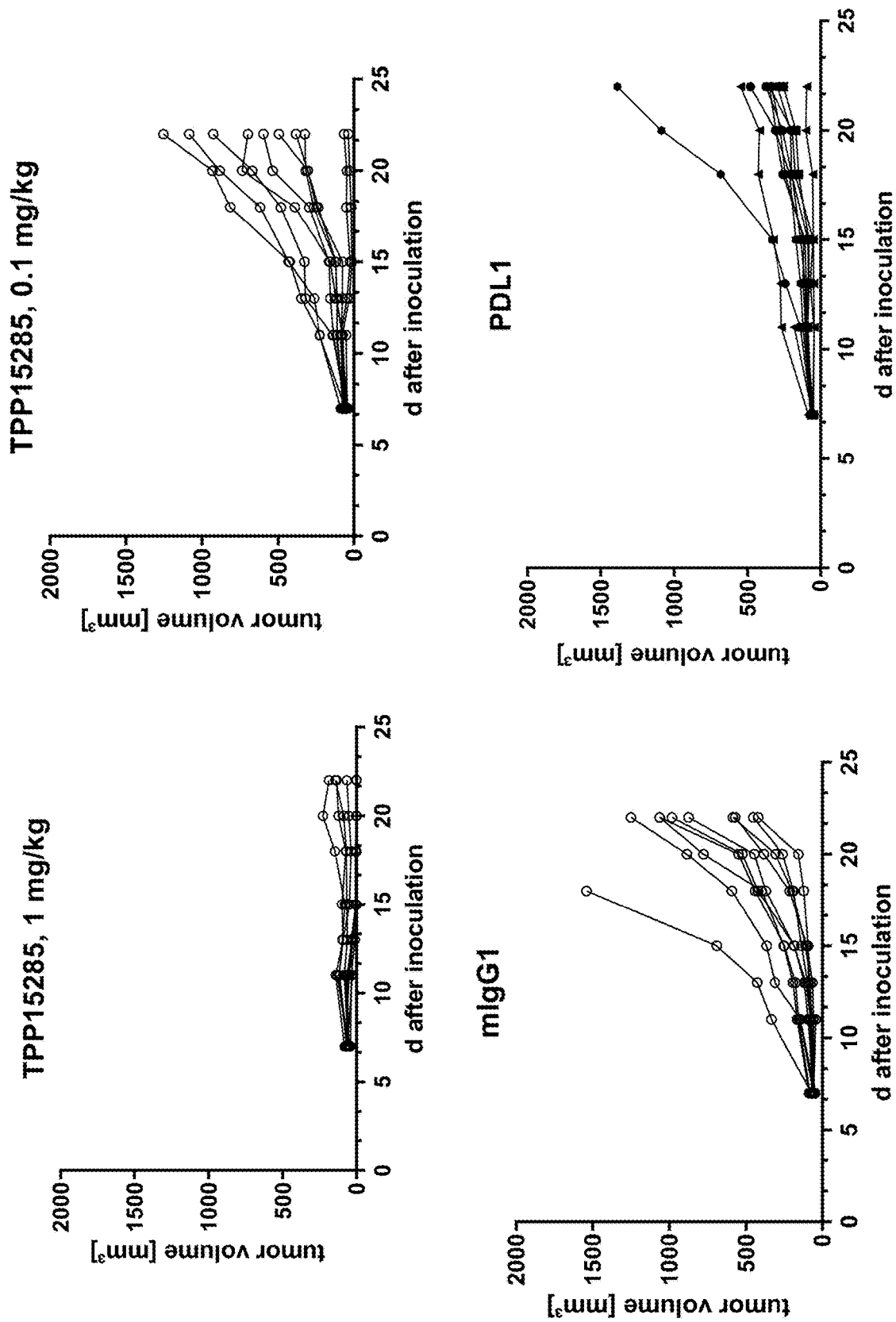

Spider plots (tumor growth of individual mice over time) of the corresponding treatment groups (FIG. 42) clearly demonstrated homogenously strong efficacy with complete responses occurring in all dose-groups with both anti-CCR8 antibodies.

Treg analysis of CT26 tumor samples 24 hours after the second antibody treatment by flow cytometry showed strongly reduced numbers of Tregs in the anti-CCR8 antibody treated group versus the isotype control group. Treg depletion was clearly dose-dependent in case of TPP-15285 (FIG. 43).

TABLE 12.2.1

Figure 43:
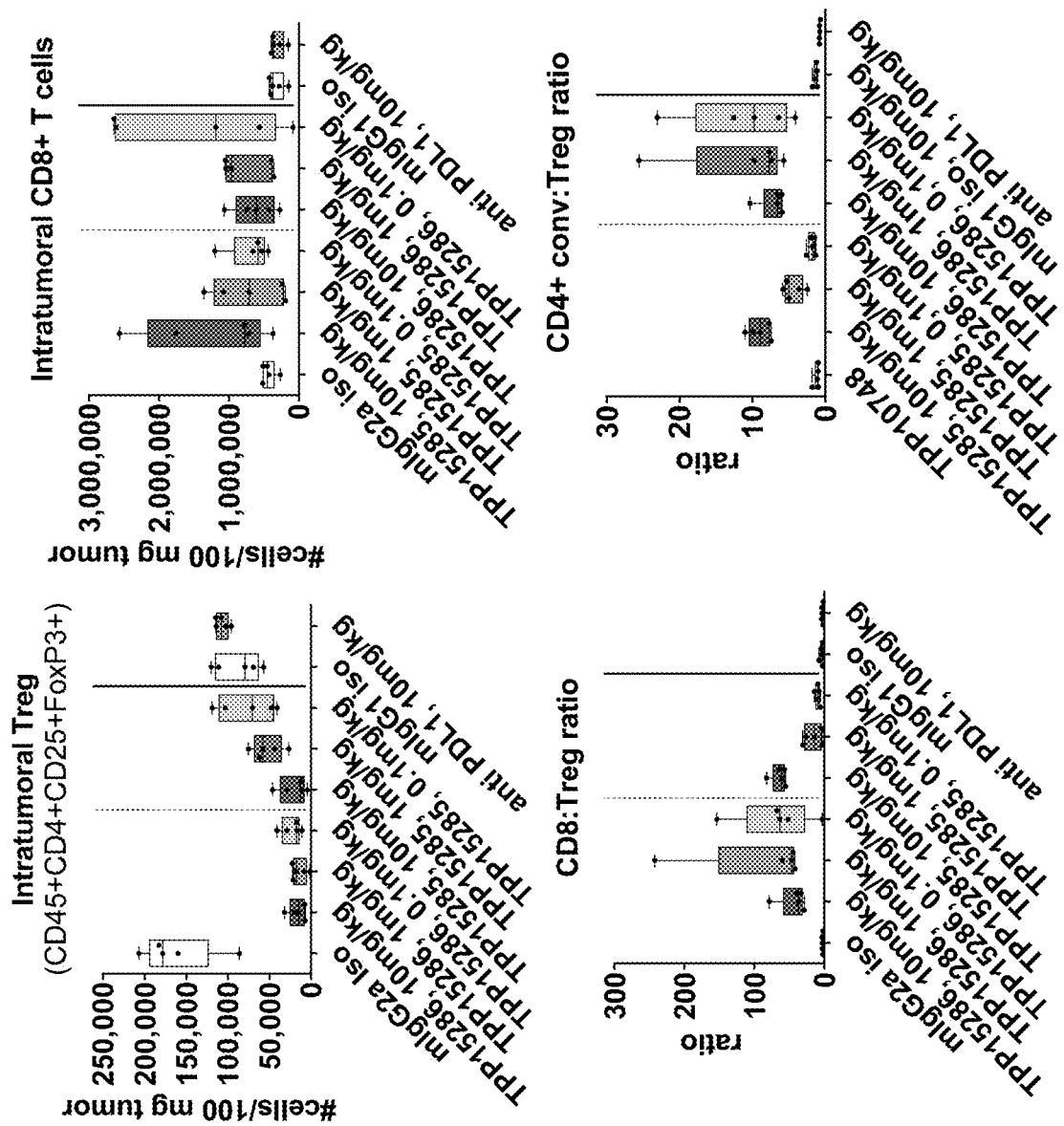
FIG. 43: FACS analysis of intra-tumoral immune cells 24 hours after second antibody treatment. Analysis of intra-tumoral Tregs. Anti-CCR8 antibody TPP15285 leads to an average decrease of intra-tumoral Tregs to 13%, 33%, or 47% of the Tregs in the isotype control, for 10 mg/kg, 1 mg/kg or 0.1 mg/kg, respectively. Anti-CCR8 antibody TPP15286 leads to an average decrease of intra-tumoral Tregs to 10%, 9% or 14% of the Tregs in the isotype control, for 10 mg/kg, 1 mg/kg or 0.1 mg/kg, respectively, cf. Table 12.2.1. Analysis of intra-tumoral CD8+ T cells. Mean increase in % of isotype control is shown in Table 12.2.1. Analysis of ratio of CD8+ T cells to Treg cells. Anti-CCR8 antibody TPP15286 leads to an average increase of the CD8+ cell to Treg cell ratio of 44 (10 mg/kg), 87 (1 mg/kg) or 68 (0.1 mg/kg). Anti-CCR8 antibody TPP15285 leads to an average increase of the CD8+ cell to Treg cell ratio of 64 (10 mg/kg), 16 (1 mg/kg) or 10 (0.1 mg/kg). Analysis of ratio of CD4+ conv T cells to Treg cells.

Corresponding data from FIG. 43.

| CT26 | Mean # Tregs | % Tregs relative to iso ctrl | Mean # CD8+ T cells | % CD8+ T cells relative to iso ctrl | Ratio CD8+ T cells:Tregs | Ratio CD4+ conv cells:Tregs |
|---|---|---|---|---|---|---|
| mIgG2a Iso | 162741 | 100 | 437223 | 100 | 3 | 1 |
| TPP-15285, 10 mg/kg | 20872 | 13 | 1239497 | 283 | 64 | 9 |
| TPP-15285, 1 mg/kg | 53303 | 33 | 716253 | 164 | 16 | 4 |
| TPP-15285, 0.1 mg/kg | 76360 | 47 | 684058 | 156 | 10 | 2 |
| TPP-15286, 10 mg/kg | 16321 | 10 | 624631 | 143 | 44 | 7 |
| TPP-15286, 1 mg/kg | 14349 | 9 | 765654 | 175 | 87 | 11 |
| TPP-15286, 0.1 mg/kg | 23202 | 14 | 1421674 | 325 | 68 | 11 |
| mIgG1 iso | 87365 | 100 | 326799 | 100 | 4 | 1 |
| anti-PDL1, 10 mg/kg | 107029 | 123 | 313229 | 96 | 3 | 1 |

Example 12.3: Mode of Action Studies

Example 12.3.1: ADCC/ADCP Mode of Action Studies in CT26-Tumor Bearing Mice

Aglycosylated antibodies, which can be produced in prokaryotic hosts show almost identical antigen-binding affinity, stability at a physiological temperature, and in vivo serum persistence compared with glycosylated counterparts. However, the absence of N-linked glycans abrogates nearly all FcγR-binding affinity and immune effector functions that are essential for clearing antibody-opsonized target cells via ADCC or ADCP. To provide evidence for the ADCC/ADCP based mode of action, aglycosylated versions of the antibodies were generated as a negative control.

TPP-18208 and TPP-18209 are aglycosylated human IgG1 versions of anti-CCR8 surrogate antibodies and are unable to bind effector cells, such as NK cells and/or macrophages, via Fc-gamma-receptors. These antibodies were tested for anti-tumor efficacy in CT26 tumor bearing mice and were compared with the respective wild-type/glycosylated counterparts comprising the same sequence (TPP-14095, TPP-14099). In addition, anti-CCR8 antibodies TPP-15285 and TPP-15286 (glycosylated, mIgG2 isotype) were included in the study.

Figure 44:
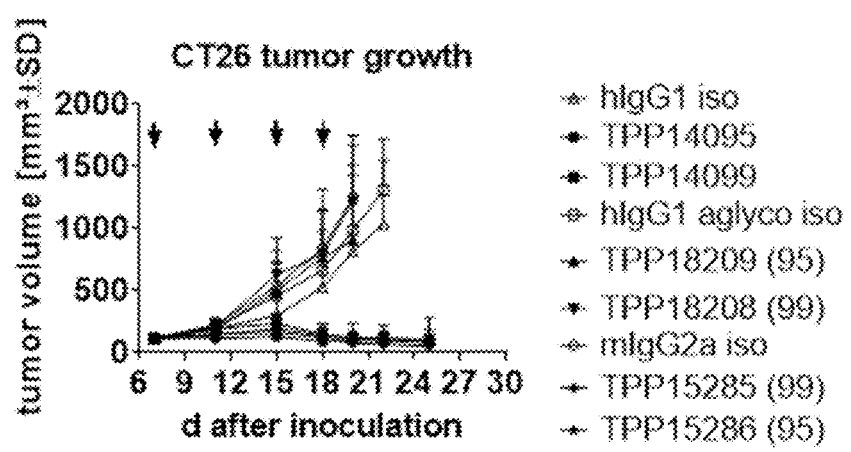
FIG. 44: CT26 tumor growth after treatment with glycosylated (TPP-14095, TPP-14099, TPP-15285, TPP-15286) or aglycosylated (TPP-18208, TPP-18209) anti-CCR8 antibodies. Aglycosylation largely abolished the anti-tumor effect.
Figure 45:
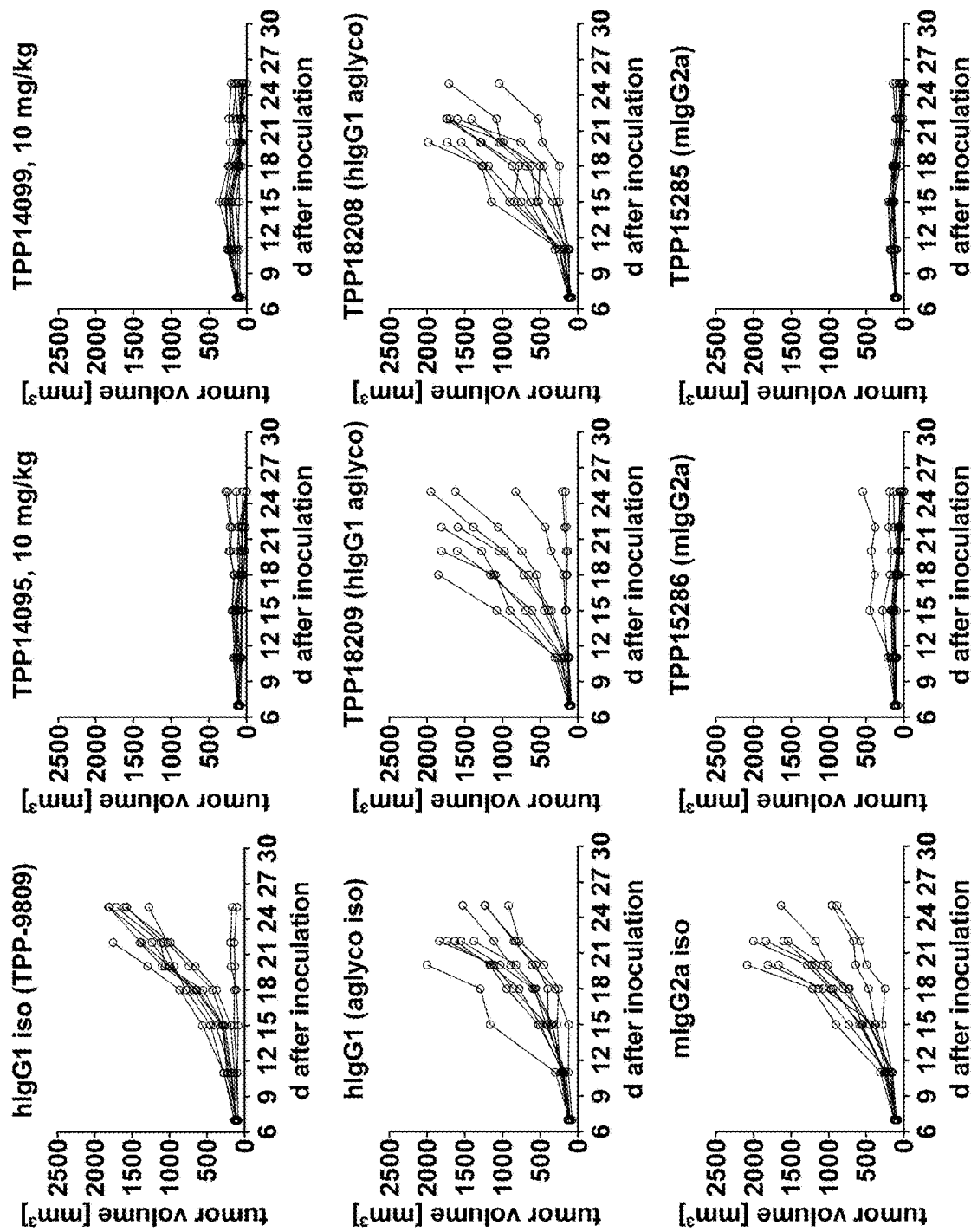
FIG. 45: Spider plots of CT26 tumor bearing mice after treatment with glycosylated (TPP-14095, TPP-14099, TPP-15285, TPP-15286) or aglycosylated (TPP-18208, TPP-18209) anti-CCR8 antibodies. Aglycosylation largely abolished the anti-tumor effect, suggesting an ADCC/ADCP dependent mechanism of anti-tumor efficacy.
Figure 46:
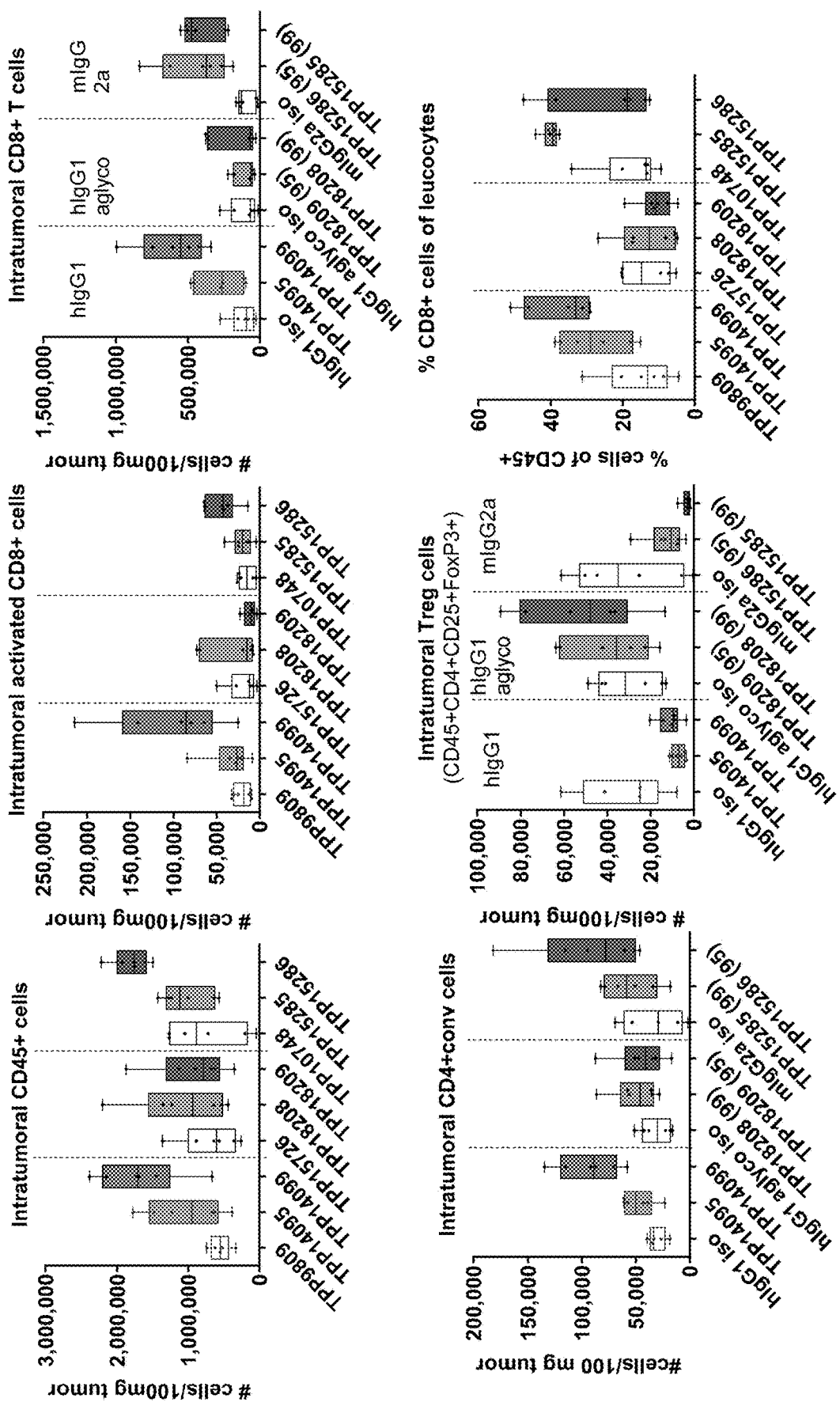
FIG. 46: FACS analysis of immune cells 24 hours after second antibody treatment. Absolute numbers of intra-tumoral CD45+ cells. Absolute numbers of intra-tumoral CD45+CD8+ T cells. Absolute numbers of intra-tumoral CD8+ T cells. Absolute numbers of intra-tumoral CD4+ conv cells. Analysis of intra-tumoral Treg depletion by flow cytometry showing absolute cell numbers. Average percentage of residual Tregs relative to the respective isotype control after antibody administration was 15.6% for TPP-14095, 28.2% for TPP-14099, 8.7% for TPP-15285 and 36.5% for TPP-15286. For the aglycosylated antibodies no reduction in Tregs was observed. % CD8+ T cells of intra-tumoral CD45+ cells. CD8+ T cells:Treg ratio. CD4+ conv:Treg ratio. Percentage Treg cells of CD4+ T cells. Absolute numbers of intra-tumoral 4-1BB+ Treg cells. Absolute numbers of intra-tumoral 4-1BB+CD4+ conv cells.

The wild-type antibodies showed a strong anti-tumor efficacy, while the aglycosylated antibodies did not show any efficacy compared to the isotype control (FIG. 44). Spider plots illustrate the results for individual mice in each treatment group (FIG. 45). Accordingly, ex vivo tumor analysis by flow cytometry demonstrated Treg depletion only after treatment with the wild-type (glycosylated) antibodies whereas the aglycosylated antibodies showed no Treg depletion compared to the respective non-binding isotype control (FIG. 46). These results confirmed ADCC and/or ADCP as predominant mode of action for Treg depletion by anti-CCR8 antibodies in CT26 tumors.

Example 12.3.2: B Cell or T Cell Involvement and Impact of CD8+ Cell Depletion or CD19+ Cell Depletion on Anti-Tumor Efficacy of Anti-CCR8 Antibodies To test the relevance of the presence of tumor infiltrating CD8+ T cells or CD19+ B cells on the anti-tumor efficacy of anti-CCR8 antibodies, the inventors used genetically modified C57BL6 mice expressing diphtheria toxin receptor (DTR) under the control of either the lineage specific Cd8a+ or the lineage specific Cd19+ promoter. Upon injection of diphtheria toxin (DT) CD8+ T cells or CD19+ B cells were quantitatively depleted from both the blood of the mice (data not shown) as well as from subcutaneously carried syngeneic MC38 tumors (Table 12.3.2.1).

Figure 87:
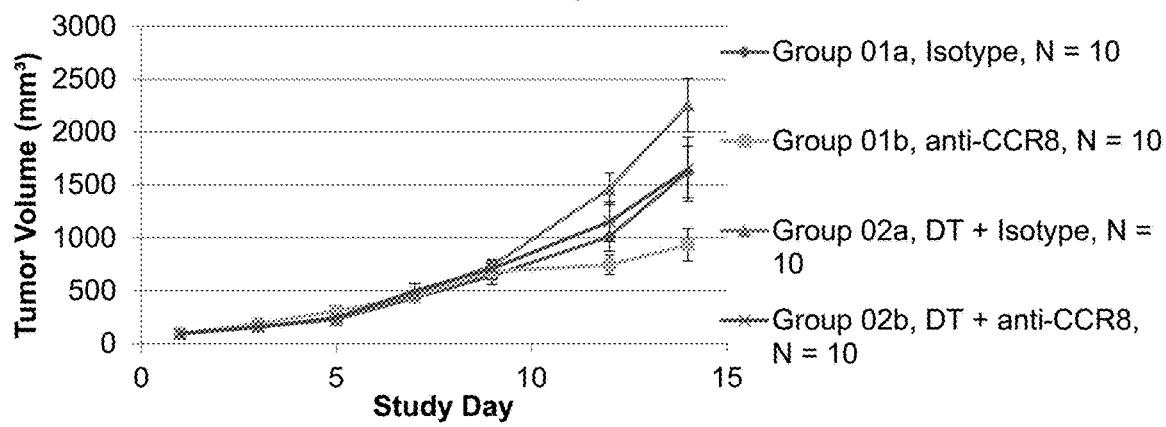
FIG. 87: Therapeutic efficacy of inventive anti-CCR8 antibody after quantitative depletion of CD8a+ expression in diphtheria toxin treated DTR mice. Depleting Cd8+ T cells abrogates anti-tumor growth effect of TPP15825 (cf. group 02b vs group 01b).
Figure 88:
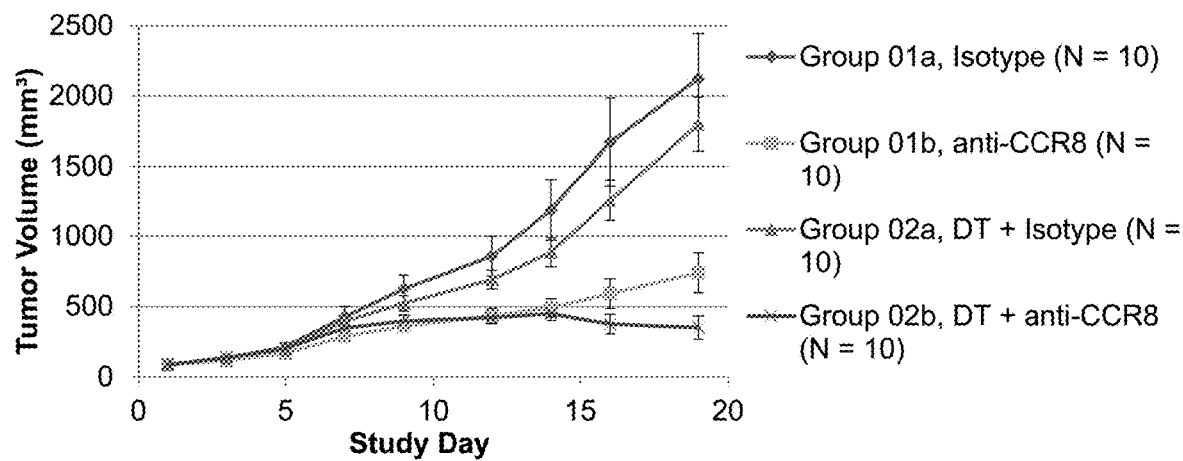
FIG. 88: Therapeutic efficacy of inventive anti-CCR8 antibody after quantitative depletion of CD19+ expression in diphtheria toxin treated DTR mice. Depleting Cd19+ B cells enhances the anti-tumor growth effect of TPP15825 (cf. group 02b vs group 01b).

As expected, depletion of CD8+ T cells completely abrogated the anti-tumor effect of anti-CCR8 treatment, resulting in tumor growth identical to that of the isotype control group (FIG. 87). These results confirmed the dependency of the anti-tumor efficacy of the inventive anti-CCR8 antibodies on the presence of CD8+ T cells. In contrast, and very surprisingly, depleting CD19+ B cells significantly increased the efficacy of TPP15285 (FIG. 88), resulting in a reduction of the T/C ratio from 0.35 to 0.16 (T-test p-value=0.032). Combining anti-CCR8 treatment with B cell depletion or B cell depleting agents such as anti-CD19 antibodies or anti-CD20 antibodies such as Rituximab is therefore suggested to further improve the cancer treatment in the clinic.

TABLE 12.3.2.1

Depletion of CD8a and CD19 expression in diphtheria toxin treated DTR mice.

| Treatment (N = 10 in each group) | Mean log2 Cd8a (mRNA levels) | Mean log2 Cd19 (mRNA levels) |
|---|---|---|
| DTR mice + Isotype [TPP-10748] | 6.919 | 1.333 |
| DTR mice + anti-CCR8 [TPP-15285, 10 mg/kg] | 7.380 | 2.002 |

TABLE 12.3.2.1-continued

Depletion of CD8a and CD19 expression in diphtheria toxin treated DTR mice.

| Treatment (N = 10 in each group) | Mean log2 Cd8a (mRNA levels) | Mean log2 Cd19 (mRNA levels) |
|---|---|---|
| CD19-DTR + DT + Isotype | 7.466 | 0.406 |
| CD19-DTR + DT + anti-CCR8 [TPP-15285, 10 mg/kg] | 9.039 | 0.000 |
| CD8-DTR + DT + Isotype | 0.711 | 1.766 |
| CD8-DTR + DT + anti-CCR8 [TPP-15285, 10 mg/kg] | 2.736 | 1.592 |

TABLE 12.3.2.2

Treatment groups to evaluate influence of CD19+ B cell depletion or CD8+ T cell depletion.

| Group | Treatment | Dose | Route | Dose scheme | T/C (CD8 depleted) | T/C (CD19 depleted) |
|---|---|---|---|---|---|---|
| 01a | Isotype control | 10 mg/kg | i.p. | BIW | 1 | 1 |
| 01b | Anti-CCR8 antibody TPP15285 | 10 mg/kg | i.p. | BIW | 0.58 | 0.35 |
| 02a | Isotype control with 0.015 mg/kg Diphtheria toxin | 10 mg/kg | i.p. | BIW | 1.39 | 0.75 |
| 02b | Anti-CCR8 antibody TPP15285 with 0.015 mg/kg Diphtheria toxin | 10 mg/kg | i.p. | BIW | 1.01 | 0.2 |

Example 12.3.3: Time Course of Increasing CD8/FOXP3 Ratios in CT26 Syngeneic Tumor Bearing Mice To gain some mechanistic insights into the immune cell levels, mRNA levels of CD8 and FOXP3 were monitored in CT26 syngeneic tumor bearing mice treated with TPP15285 or isotype control. 10 tumors were harvested for RNA-seq analysis directly before administering the first dose as well as 12 h, 24 h, 36 h, 48 h, 72 h after the first dose was administered. Similarly, tumors were harvested 24 h after administration of a second, third and fourth dose of TPP15285. All tumors were subjected to RNA-seq analysis to measure murine Foxp3, CD8a, and CD8b1 mRNA levels. Ratios of mean Cd8a and Cd8b1 to Fopx3 ratios were computed and the significance of the differences in the ratios between the control and TPP15285 treated groups was computed via a T-test.

CD8 to FOXP3 mRNA ratios varied between a value of 0.9 and a value of around 2.0 in the isotype control and the earliest time points after TPP15285 treatment, but then significantly increased in the TPP15285 groups to values of 5.8, 3.9, and 4.4 at 72 h after 1st dose, 24 h after 2nd dose, and 24 h after 3rd dose, respectively, demonstrating significant depletion of regulatory T cells by TPP15285. Ratios fell back to a value of 2.6 at 24 h after the 4th dose was administered.

TABLE 12.3.3.1

CD8/FOXP3 ratio of mRNA levels measured at different time points after administration of TPP15285 or isotype control.

| Time point | TPP15285 CD8/ FOXP3 ratio | Isotype CD8/ FOXP3 ratio | T-test p-value |
|---|---|---|---|
| Day 11, 0 h after 1st dose | 1.433 | 1.822 | 4.0E−01 |
| Day 11, 12 h after 1st dose | 0.900 | 1.468 | 1.7E−01 |
| Day 12, 24 h after 1st dose | 1.589 | 0.911 | 2.5E−01 |
| Day 12, 36 h after 1st dose | 1.965 | 1.012 | 1.3E−01 |
| Day 13, 48 h after 1st dose | 2.386 | 0.976 | 5.5E−03 |
| Day 14, 72 h after 1st dose | 5.755 | 1.721 | 4.3E−02 |
| Day 15, 24 h after 2nd dose | 3.882 | 2.028 | 9.4E−02 |
| Day 18, 24 h after 3rd dose | 4.424 | 1.727 | 3.7E−03 |
| Day 22, 24 h after 4th dose | 2.579 | 1.870 | 1.6E−01 |

Example 12.4: Efficacy of CCR8-Antibody TPP-15285 in EMT6-Tumor Bearing Mice

Figure 47:
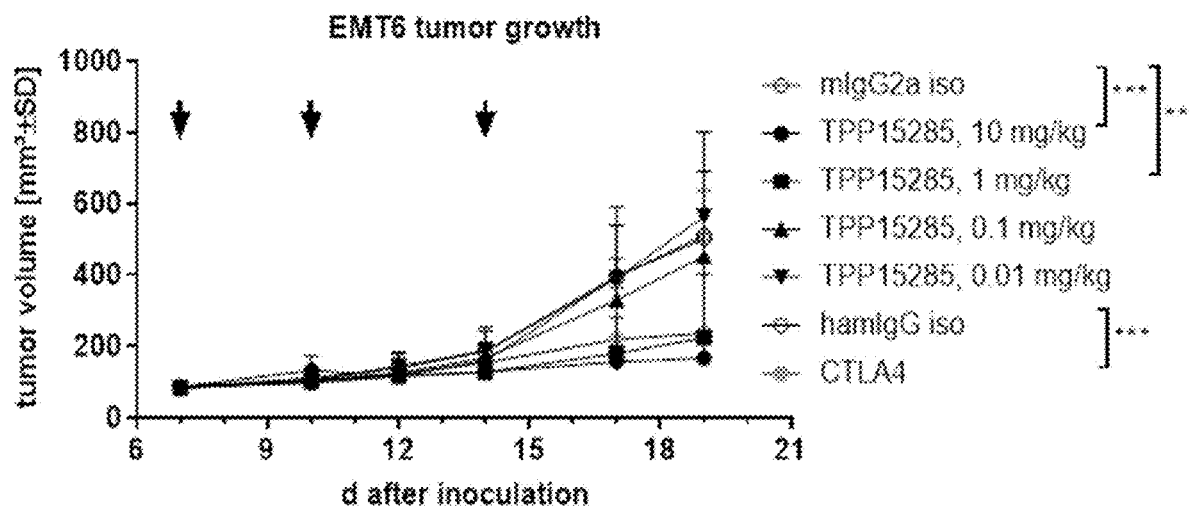
FIG. 47: EMT6 tumor growth after treatment with different doses of anti-CCR8 antibody TPP-15285. Significance was determined by 1-Way ANOVA plus Sidak's post-test after log transform.
Figure 48:
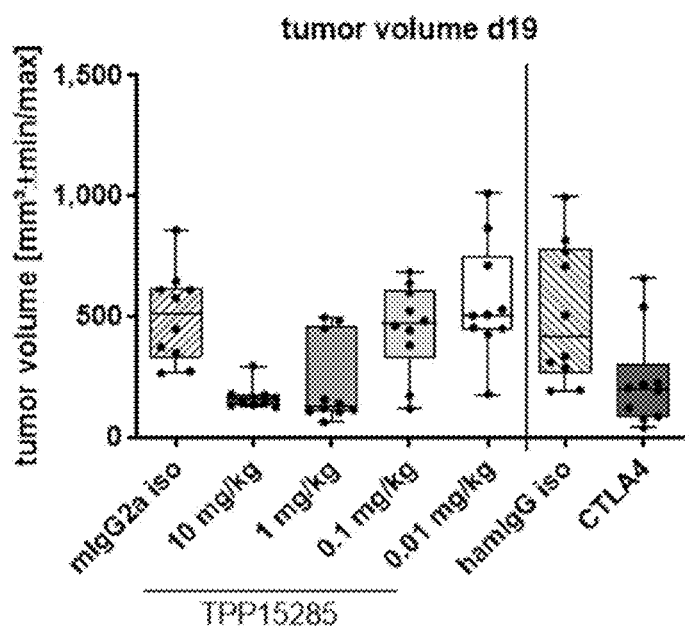
FIG. 48: EMT6 tumor growth at day 19 after treatment with different doses of anti-CCR8 antibody TPP-15285 or anti-CTLA4 antibody.
Figure 49:
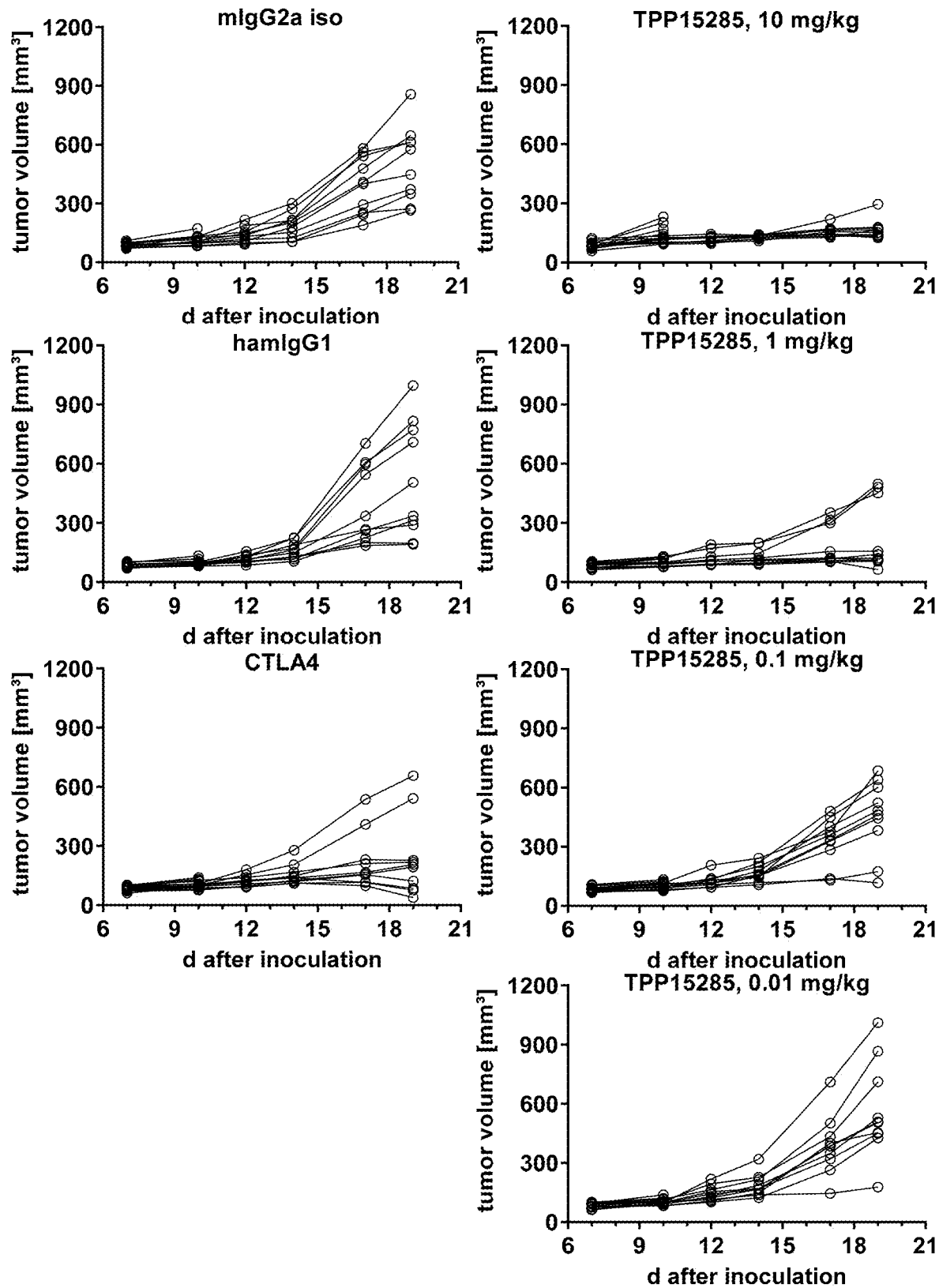
FIG. 49: Spider plots of EMT6-tumor bearing mice after treatment with different doses of anti-CCR8 antibody TPP-15285 or anti-CTLA4 antibody.

Example 12.4.1: Efficacy of CCR8-Antibody TPP-15285 in EMT6-Tumor Bearing Mice—Different Dosing The anti-CCR8 surrogate antibody TPP-15285 showed dose-dependent efficacy in EMT6 tumor bearing mice with the strongest effect in the 10 mg/kg dose group. For this dose, TPP-15285 had a superior efficacy over anti-CTLA4 antibody (FIG. 47, FIG. 48). Strong efficacy was still observed in the 1 mg/kg dose group whereas the 0.1 and 0.01 mg/kg dose groups showed almost no efficacy. Spider plots illustrate these results on an individual mouse level (FIG. 49).

Figure 50:
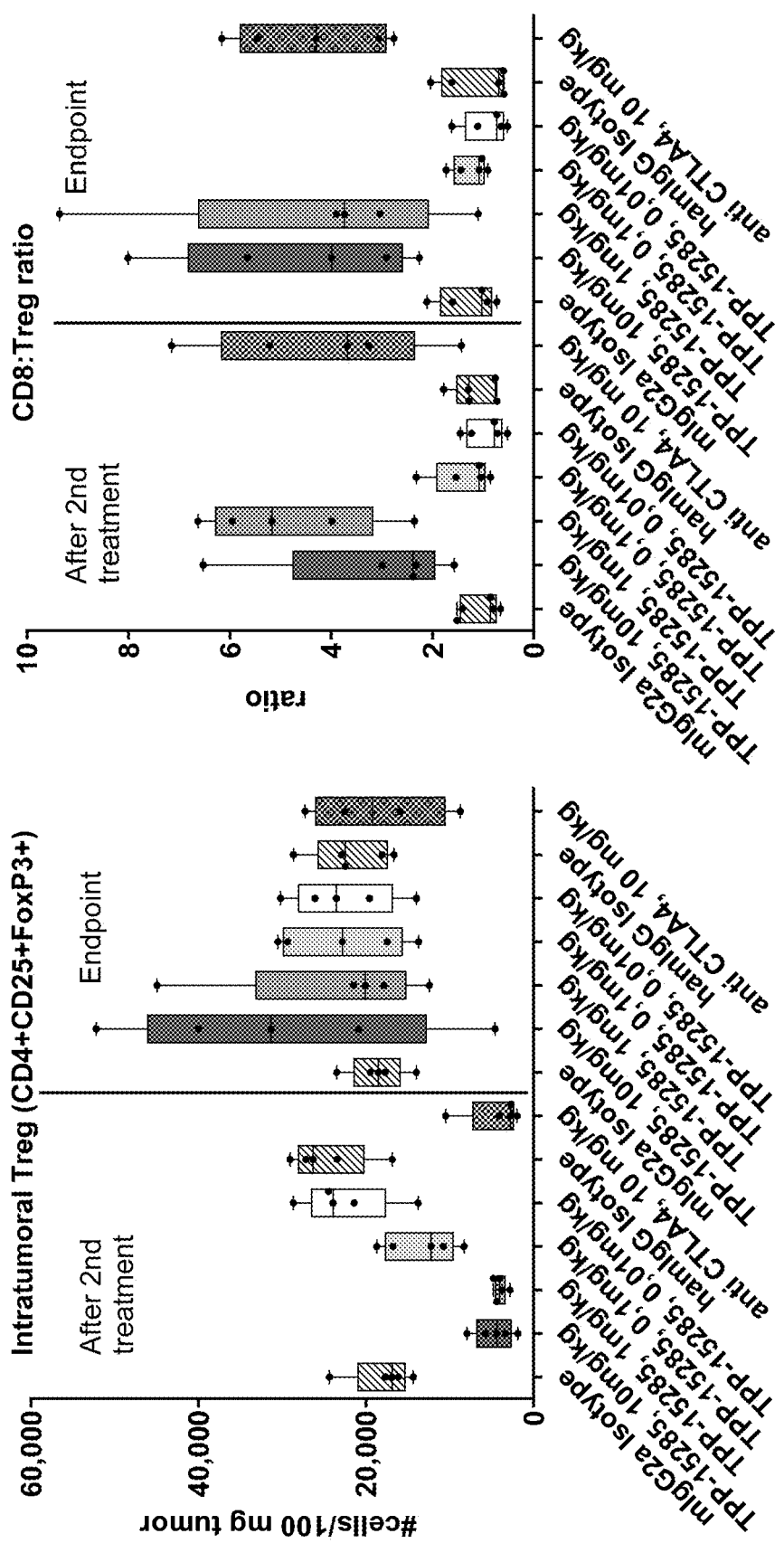
FIG. 50: FACS analysis of immune cells of EMT6-tumor bearing mice after treatment with different doses of CCR8-antibody TPP-15285 or anti-CTLA4 antibody, 24 hours after second treatment or at the end of the study. Absolute numbers of intra-tumoral Treg cells. Significant differences were observed e.g. for 10 mg/kg of anti-CCR8 antibody at both timepoints. CD8 positive cells to Treg ratio. CD4+ conv cells to Treg ratio. Percentage Treg cells of CD4+ T cells.
Figure 50:
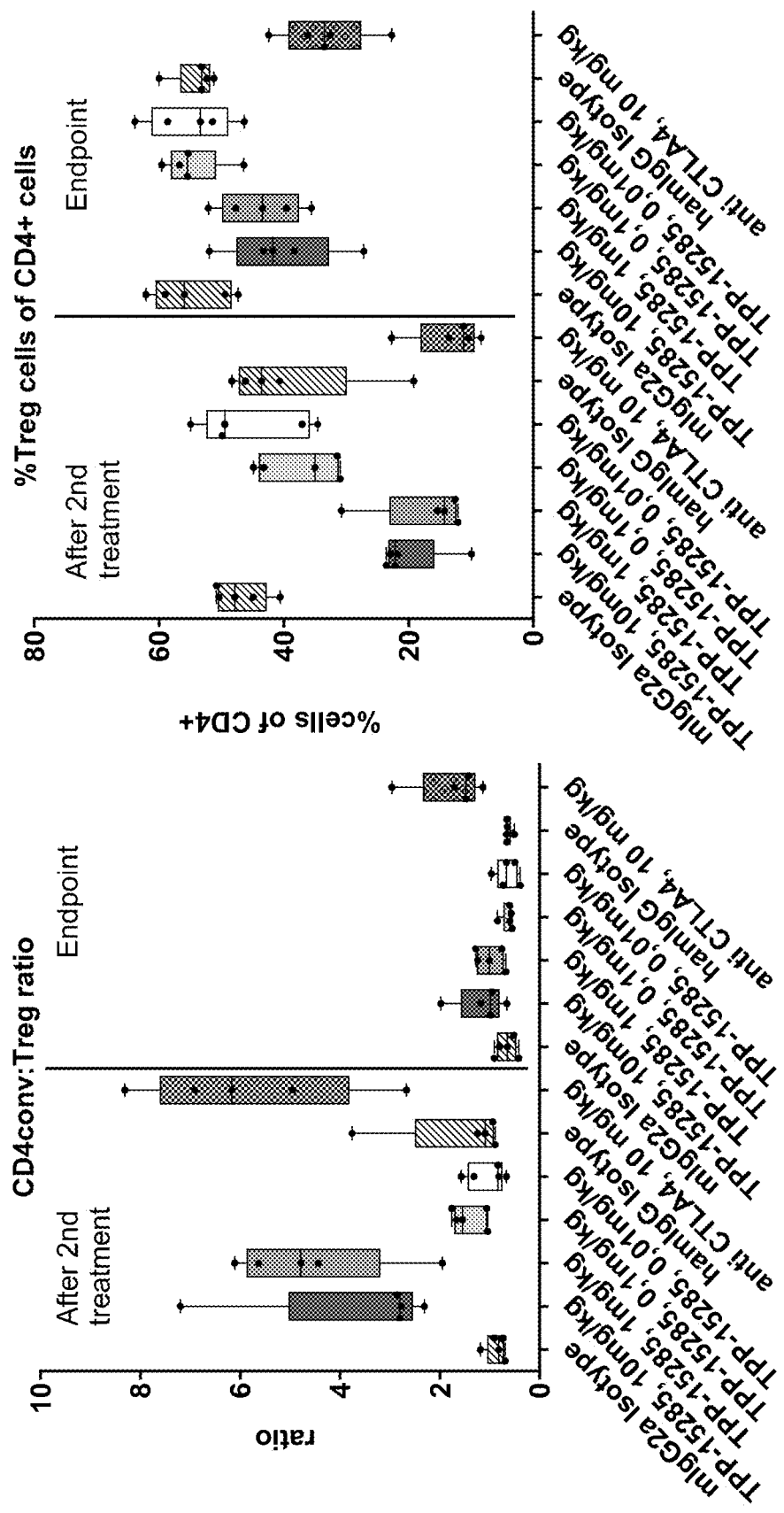
Figure 51:
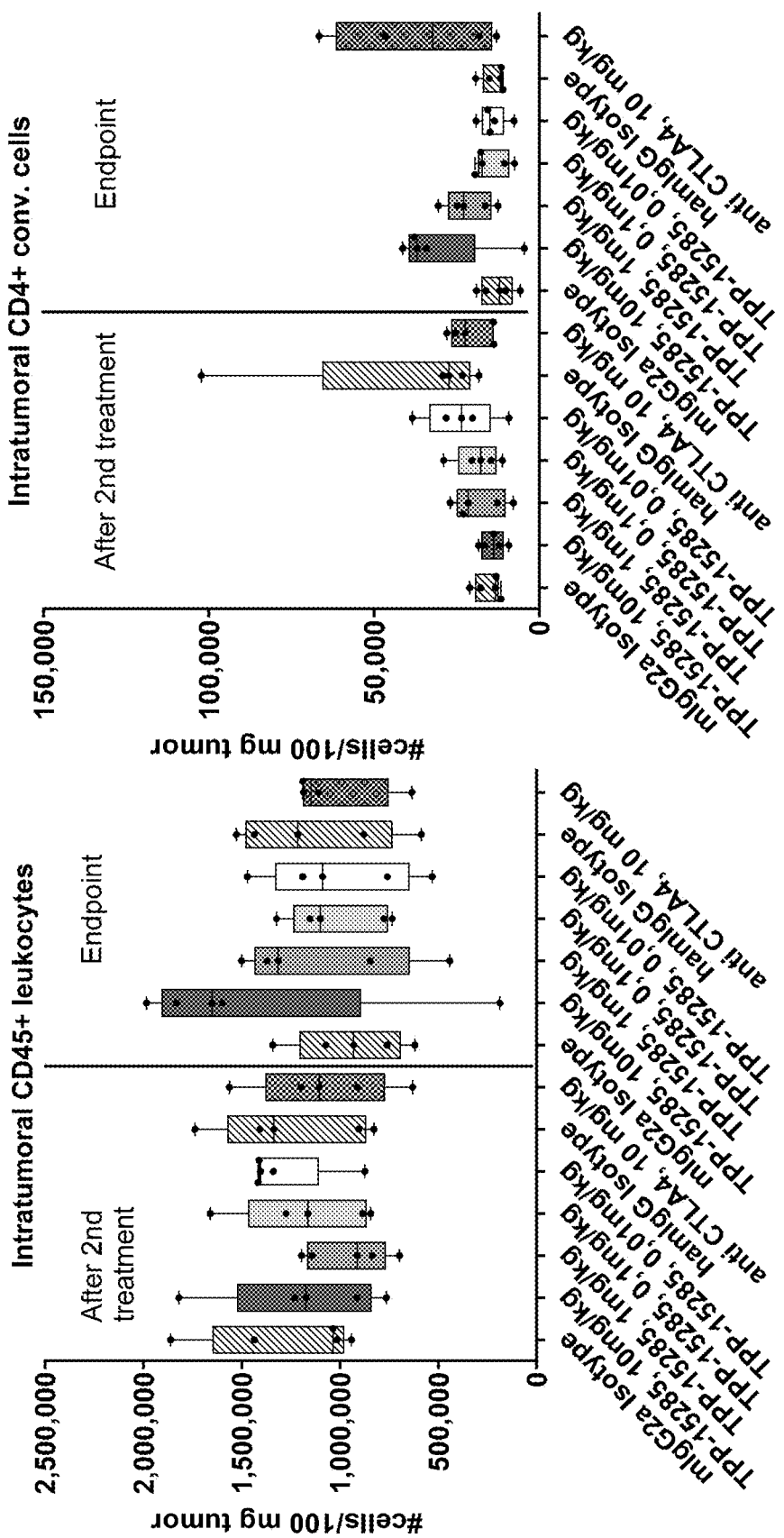
FIG. 51: FACS analysis of immune cells of EMT6-tumor bearing mice after treatment with different doses of anti-CCR8 antibody TPP-15285 or anti-CTLA4 antibody, 24 hours after second treatment or at the end of the study. Absolute numbers of intra-tumoral CD45+ cells. Absolute numbers of intra-tumoral CD4+ conv cells. Absolute numbers of intra-tumoral CD4+ T cells. Absolute numbers of intra-tumoral activated CD8+ T cells. Absolute numbers of intra-tumoral NK cells. Absolute numbers of intra-tumoral CD8+ T cells. Differences were observed e.g. for 10 mg/kg of anti-CCR8 antibody at the end of the study.
Figure 51:
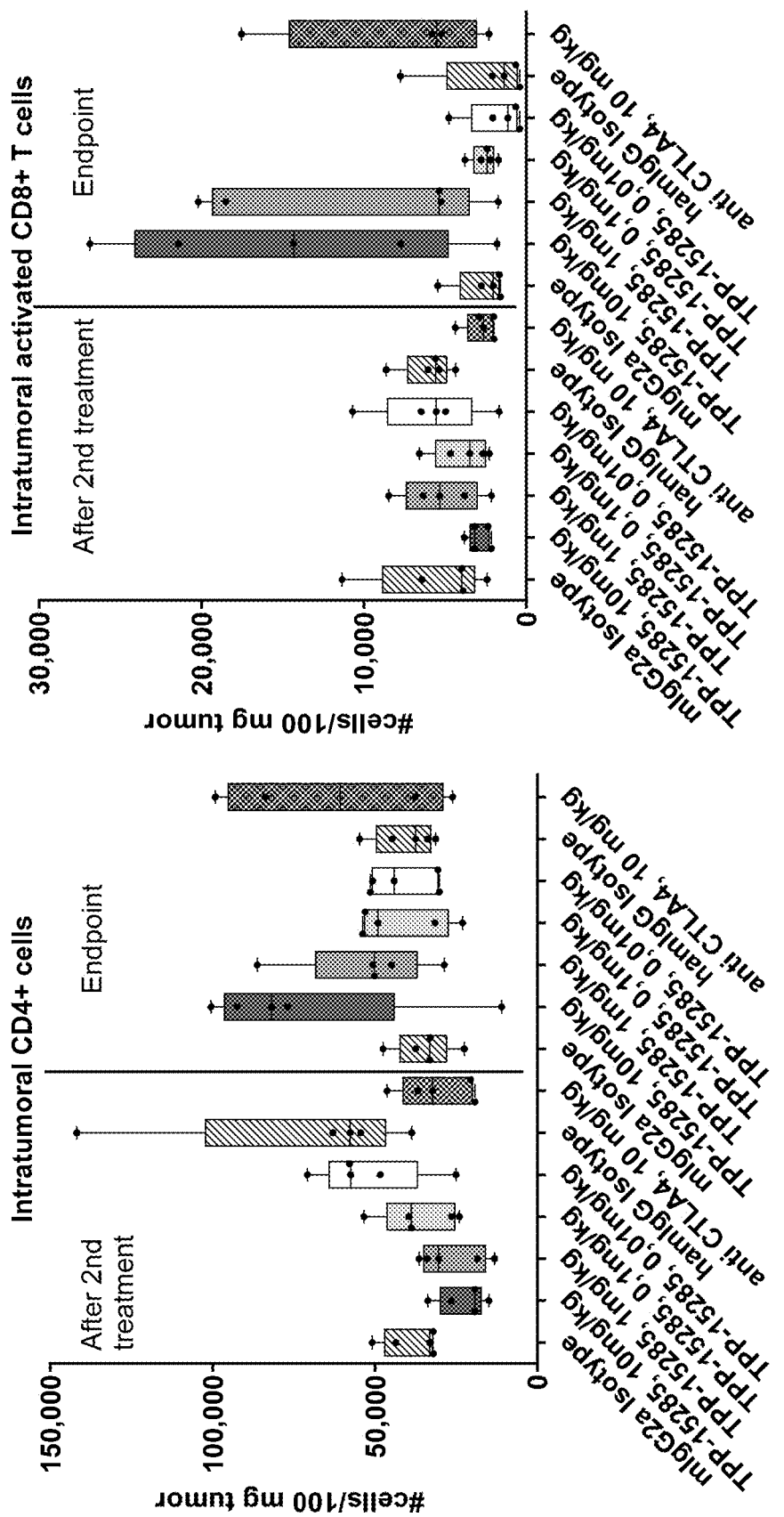
Figure 51:
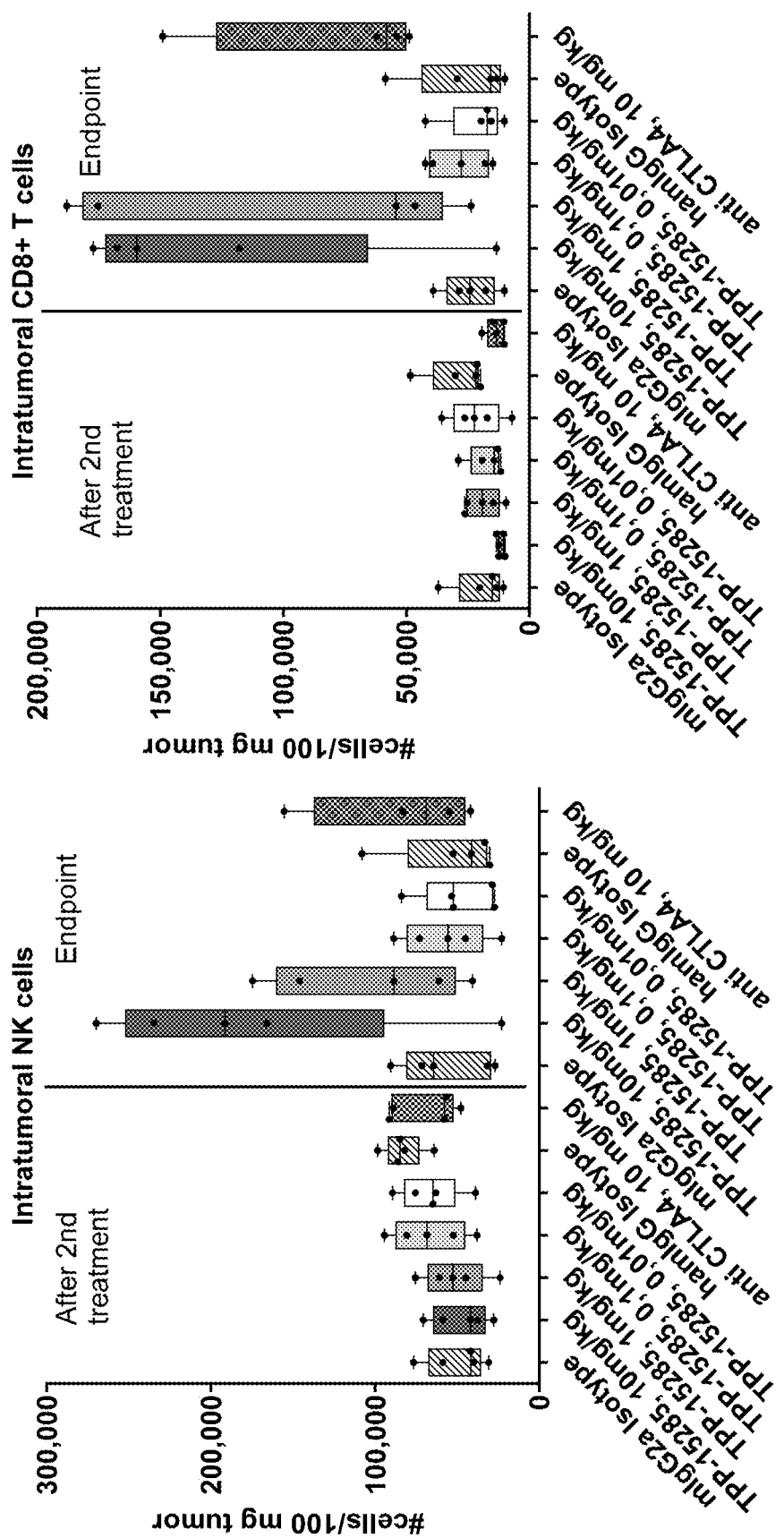

Treg analysis of EMT6-tumor samples 24 hours after the second antibody treatment by flow cytometry showed strongly reduced numbers of Tregs in the anti-CCR8 antibody treated versus the isotype control group. Treg depletion was clearly dose-dependent (FIG. 50). Treg depletion was also observed for anti-CTLA4, as previously described in literature. Additionally, a strong increase of CD8+ T cells in the tumors sampled at study end were demonstrated for the efficacious dose groups 10 mg/kg and 1 mg/kg of TPP-15285 as well as for anti-CTLA4 (FIG. 51). Further alterations of immune cell populations are shown in Table 12.4.1.1 and Table 12.4.1.2.

TABLE 12.4.1.1

Relative percentage of immune cell populations determined by FACS analysis of immune cells 24 hours after second treatment of EMT6-tumor bearing mice with different doses of CCR8-antibody TPP-15285, or at the end of the study.

| | EMT6 | mIgG2a Iso | TPP-15285, 10 mg/kg | TPP-15285, 1 mg/kg | TPP-15285 0.1 mg/kg | TPP-15285, 0.01 mg/kg | HamIgG iso | aCTLA4 10 mg/kg |
|---|---|---|---|---|---|---|---|---|
| FACS 24h after 2nd treatment | Mean % CD45+ relative to iso | 100 | 94 | 76 | 93 | 102 | 100 | 87 |
| | Mean % CD4conv+ relative to iso | 100 | 91 | 120 | 121 | 155 | 100 | 52 |
| | Mean % CD4+ relative to iso | 100 | 59 | 69 | 95 | 135 | 100 | 44 |
| | Mean % activated CD8+ relative to iso | 100 | 52 | 93 | 70 | 105 | 100 | 47 |
| | Mean % NK cells relative to iso | 100 | 95 | 104 | 135 | 134 | 100 | 82 |
| | Mean % CD8+ T cells relative | 100 | 61 | 99 | 90 | 113 | 100 | 48 |
| FACS at study end | Mean % CD45+ relative to iso | 100 | 153 | 116 | 108 | 107 | 100 | 91 |
| | Mean % CD4conv+ relative to iso | 100 | 245 | 169 | 115 | 112 | 100 | 262 |
| | Mean % CD4+ relative to iso | 100 | 209 | 150 | 121 | 119 | 100 | 152 |
| | Mean % activated CD8+relative to iso | 100 | 532 | 377 | 96 | 67 | 100 | 314 |
| | Mean % NK cells relative to iso | 100 | 310 | 179 | 100 | 86 | 100 | 158 |
| | Mean % CD8+30 T cells relative | 100 | 529 | 406 | 119 | 88 | 100 | 309 |

TABLE 12.4.1.2

Relative percentage of Tregs, CD8:Treg ratio or CD4conv:Treg ratio determined by FACS analysis of immune cells 24 hours after second treatment of EMT6-tumor bearing mice with different doses of CCR8-antibody TPP-15285, or at the end of the study.

| | EMT6 | mIgG2a Iso | TPP-15285, 10 mg/kg | TPP-15285, 1 mg/kg | TPP-15285 0.1 mg/kg | TPP-15285, 0.01 mg/kg | HamIgG iso | aCTLA4 10 mg/kg |
|---|---|---|---|---|---|---|---|---|
| FACS analysis 24h after second treatment | Mean % Treg relative to iso | 10 | 26 | 22 | 75 | 126 | 100 | 18 |
| | CD8:Treg ratio | 1.1 | 3.2 | 4.8 | 1.4 | 0.9 | 1.2 | 4.1 |
| | CD4conv:Treg ratio | 0.9 | 3.6 | 4.6 | 1.4 | 1 | 1.6 | 5.8 |
| FACS analysis at study end | Mean % Treg relative to iso | 100 | 160 | 125 | 122 | 122 | 100 | 86 |
| | CD8:Treg ratio | 1.3 | 4.6 | 4.2 | 1.2 | 0.9 | 1.1 | 4.3 |
| | CD4conv:Treg ratio | 1.2 | 1 | 0.6 | 0.7 | 0.6 | 1.7 | 1.7 |

Example 12.4.2: Efficacy of CCR8-Antibody TPP-15285 in EMT6-Tumor Bearing Mice—Single or Multiple Dosing Murine breast cancer model EMT-6 was used with TPP-15285 to test the impact of single vs. multiple dosing. Four different treatment schemes were tested: single treatment, two times BIW treatment, three times BIW treatment, or four times BIW treatment. Each group was treated with vehicle control or 0.1 mg/kg, 1 mg/kg, or 5 mg/kg of TPP-15285. In addition to the efficacy study, satellite animals were sacrificed for ex vivo phenotyping at 24 hr, 48 hr, and 120 hr after treatments. Antibody administration occurred i.p. but other routes can be used.

Figure 85:
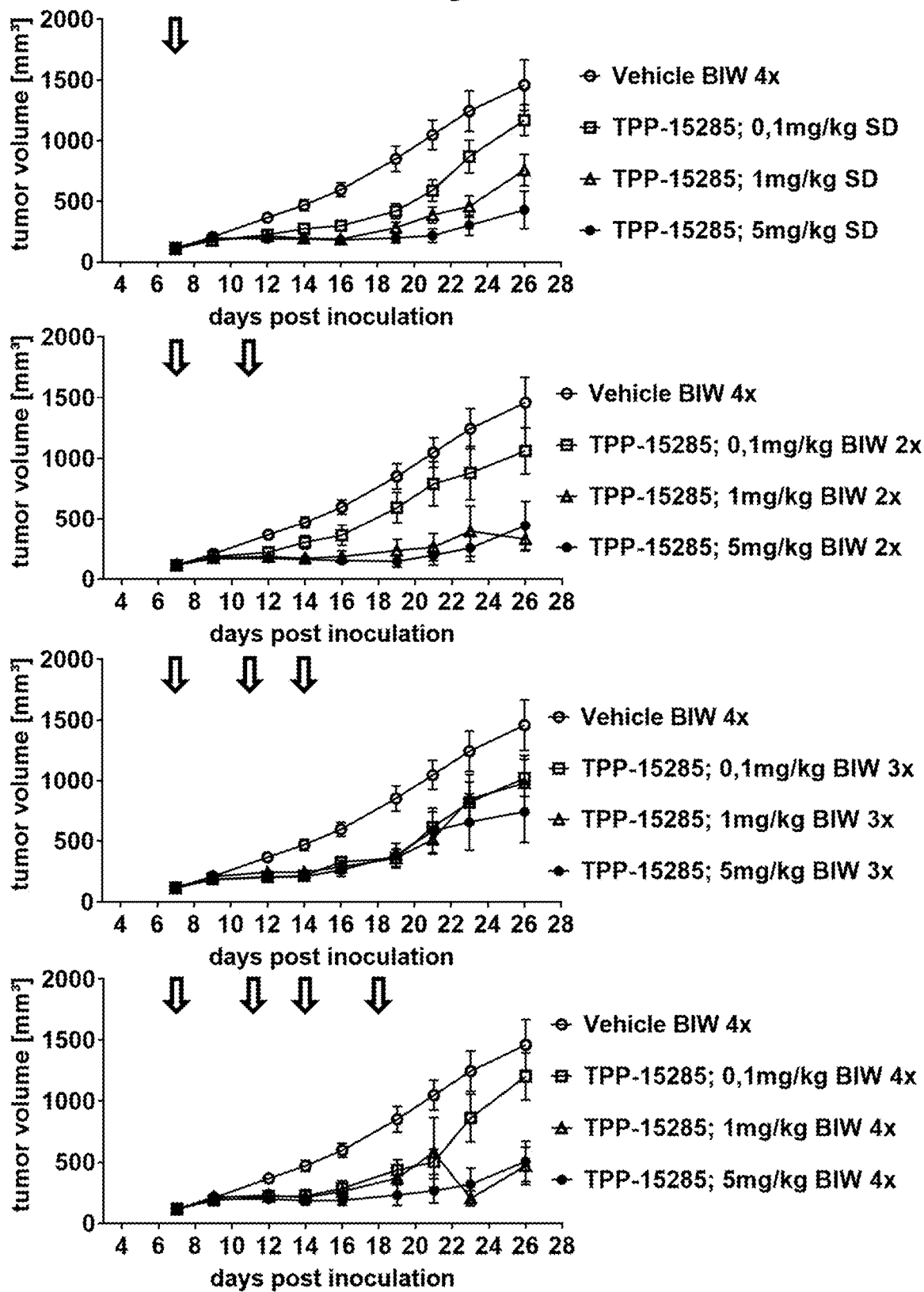
FIG. 85: Efficacy of CCR8-antibody TPP-15285 in EMT6-tumor bearing mice treated with four different treatment schemes: single treatment, two times BIW treatment, three times BIW treatment, or four times BIW treatment. Each group was treated with vehicle control or 0.1 mg/kg, 1 mg/kg, or 5 mg/kg of TPP-15285.
Figure 86:
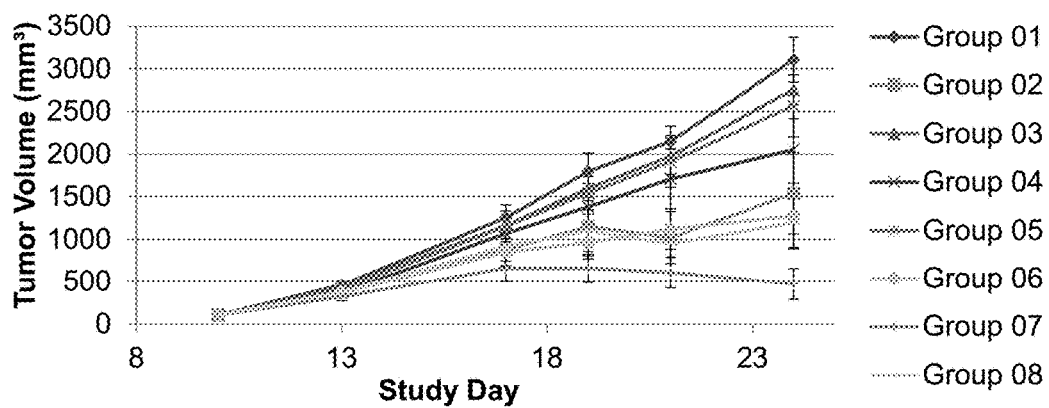
FIG. 86: Therapeutic efficacies of inventive anti-CCR8 antibody, anti-PD-1 antibody, anti-PD-L1 antibody, or Paclitaxel tested alone or in combination in MBT2 syngeneic tumor bearing mice as shown in Table 12.6.9.1.

Efficacy data for single treatment, two times BIW treatment, three times BIW treatment, or four times BIW treatment are shown in FIG. 85. Interestingly, single dose treatment was suitable to obtain an excellent treatment efficacy. At the study end, there was an increase in frequency, absolute number and activation of CD8+ intra-tumoral T cells, cf. Table 12.4.2.1. However, at the study end there was no difference in intra-tumoral Treg number and frequency or CCR8 expression, cf. Table 12.4.2.2. In addition, there was no difference in intra-tumoral NK cells or macrophages cell number at the end of the study or during the study (data not shown).

However, in the time course, there was a dose-dependent reduction of intra-tumoral Tregs (CD4+CD25+Foxp3+) after 1st and 2nd treatments, but less pronounced after $3^{rd}$ and 4th treatments, cf. Table 12.4.2.3. This was also observed in CCR8+ Tregs (data not shown). Furthermore, absolute numbers of CD8+ T cells increased over time, cf. Table 12.4.2.4. Accordingly, CD8 to Treg ratios increased post first dose and remained high until after the fourth dose compared to isotype controls. Characterization of blood samples did not show substantial decrease of Tregs or increase in CD8 T cells in the blood upon different treatment schedule and over time (data not shown). In addition, no change was observed in NK and macrophages in blood (data not shown).

TABLE 12.4.2.1

Absolute CD8+ cells per 100 mg tumor as determined by FACS at study end. FACS analysis revealed increase of frequency, absolute number and activation status of Cytotoxic T cells.

| Treatment | Vehicle (PBS, four treatment) Mean | SD | n | TPP-15285 0.1 mg/kg Mean | SD | n | TPP-15285 1 mg/kg Mean | SD | n | TPP-15285 5 mg/kg Mean | SD | n |
|---|---|---|---|---|---|---|---|---|---|---|---|---|
| single dose | 1802 | 1066 | 4 | 3793 | 1300 | 5 | 4435 | 2787 | 5 | 17995 | 1209 | 3 |
| 2 treatments |  |  |  | 3661 | 1826 | 5 | 6609 | 3373 | 5 | 7752 | 5470 | 5 |
| 3 treatments |  |  |  | 7800 | 8399 | 5 | 19189 | 21883 | 4 | 7358 | 4575 | 5 |
| 4 treatments |  |  |  | 10569 | 8227 | 5 | 9099 | 3561 | 5 | 17604 | 10357 | 4 |

TABLE 12.4.2.3

Absolute CD4+ CD25+ FoxP3+ Treg cells per 100 mg tumor as determined by FACS at study end.

| Treatment | Vehicle (PBS, four treatment) Mean | SD | n | TPP-15285 0.1 mg/kg Mean | SD | n | TPP-15285 1 mg/kg Mean | SD | n | TPP-15285 5 mg/kg Mean | SD | n |
|---|---|---|---|---|---|---|---|---|---|---|---|---|
| single dose | 2751 | 1624 | 4 | 2976 | 1507 | 5 | 2190 | 892 | 5 | 9366 | 594 | 3 |
| 2 treatments |  |  |  | 2686 | 1472 | 5 | 5011 | 3179 | 5 | 3413 | 1855 | 5 |
| 3 treatments |  |  |  | 3187 | 2399 | 5 | 5517 | 5406 | 4 | 2214 | 1508 | 5 |
| 4 treatments |  |  |  | 3041 | 1449 | 5 | 3349 | 1427 | 5 | 7745 | 6271 | 5 |

TABLE 12.4.2.3

Absolute CD4+ CD25+ FoxP3+ Treg cells per 100 mg tumor as determined by FACS in satellite animals.

| Time (after treatment no.) | Vehicle Mean | SD | n | TPP-15285/ 0.1 mg/kg Mean | SD | n | TPP-15285 1 mg/kg Mean | SD | n | TPP-15285 5 mg/kg Mean | SD | n |
|---|---|---|---|---|---|---|---|---|---|---|---|---|
| 24h (1) | 13013 | 2878 | 4 | 7526 | 4116 | 5 | 11395 | 9162 | 6 | 10149 | 8020 | 5 |
| 48h (1) | 12187 | 8549 | 5 | 10241 | 3097 | 6 | 4521 | 2593 | 6 | 11149 | 14745 | 6 |
| 120h (1) | 13764 | 6040 | 5 | 9884 | 5660 | 6 | 8975 | 3810 | 6 | 3008 | 2067 | 6 |
| 24h (2) | 14315 | 11220 | 3 | 7836 | 5964 | 6 | 2893 | 1347 | 4 | 1951 | 1041 | 6 |
| 48h (2) | 15022 | 7702 | 5 | 9377 | 5010 | 6 | 3478 | 2374 | 6 | 1540 | 1495 | 6 |
| 120h (2) | 5134 | 619 | 5 | 9567 | 5948 | 6 | 8922 | 8245 | 5 | 3837 | 2598 | 6 |
| 24h (3) | 11789 | 5191 | 5 | 6619 | 2723 | 4 | 4429 | 3400 | 6 | 3462 | 1954 | 6 |
| 48h (3) | 15616 | 7260 | 5 | 7258 | 3704 | 4 | 5879 | 3175 | 6 | 3750 | 1558 | 6 |
| 120h (3) |  |  |  |  |  |  |  |  |  |  |  |  |
| 24h (4) |  |  |  |  |  |  |  |  |  |  |  |  |
| 48h (4) | 7011 | 2911 | 5 | 8137 | 4271 | 6 | 12037 | 7024 | 5 | 4293 | 3191 | 5 |

TABLE 12.4.2.4

Absolute CD8+ cells per 100 mg tumor as determined by FACS in satellite animals

| Time (after treatment no.) | Vehicle Mean | SD | n | TPP-15285/ 0.1 mg/kg Mean | SD | n | TPP-15285 1 mg/kg Mean | SD | n | TPP-15285 5 mg/kg Mean | SD | n |
|---|---|---|---|---|---|---|---|---|---|---|---|---|
| 24h (1) | 12743 | 4875 | 4 | 7549 | 4679 | 5 | 17691 | 18215 | 6 | 13238 | 7023 | 5 |
| 48h (1) | 9626 | 4564 | 5 | 11880 | 4806 | 6 | 8949 | 5814 | 6 | 16745 | 15525 | 6 |
| 120h (1) | 25694 | 24727 | 5 | 13604 | 7778 | 6 | 56974 | 26915 | 6 | 19107 | 14265 | 6 |
| 24h (2) | 15518 | 6383 | 3 | 19344 | 10833 | 6 | 16597 | 6630 | 4 | 13271 | 8470 | 6 |
| 48h (2) | 18726 | 8477 | 4 | 34655 | 15707 | 6 | 33039 | 18954 | 6 | 14310 | 7167 | 6 |
| 120h (2) | 8122 | 4436 | 5 | 46685 | 34541 | 6 | 38352 | 38235 | 5 | 53765 | 26430 | 6 |

TABLE 12.4.2.4-continued

| Time (after treatment no.) | Absolute CD8+ cells per 100 mg tumor as determined by FACS in satellite animals ||||||||||||
| | Vehicle ||| TPP-15285/ 0.1 mg/kg ||| TPP-15285 1 mg/kg ||| TPP-15285 5 mg/kg |||
| | Mean | SD | n | Mean | SD | n | Mean | SD | n | Mean | SD | n |
|---|---|---|---|---|---|---|---|---|---|---|---|---|
| 24h (3) | 25371 | 22860 | 5 | 18750 | 8436 | 4 | 34955 | 10345 | 6 | 41932 | 30806 | 5 |
| 48h (3) | 32308 | 23581 | 5 | 24993 | 21998 | 4 | 39662 | 17864 | 6 | 69106 | 23874 | 6 |
| 120h (3) | | | | | | | | | | | | |
| 24h (4) | | | | | | | | | | | | |
| 48h (4) | 17885 | 14712 | 5 | 32814 | 19935 | 6 | 50298 | 13584 | 5 | 34091 | 10942 | 5 |

Figure 52:
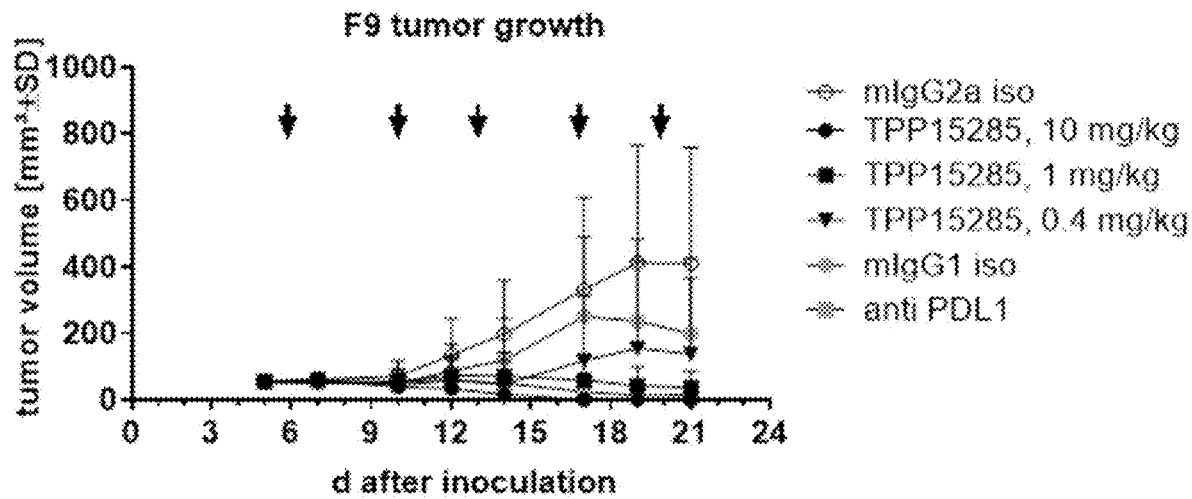
FIG. 52: F9 tumor growth after treatment with different doses of anti-CCR8 antibody TPP-15285 or anti-PDL1 antibody.
Figure 53:
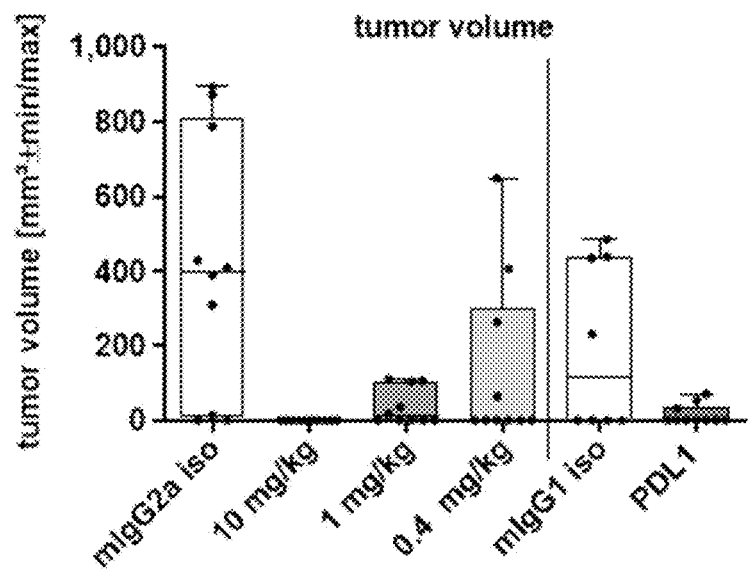
FIG. 53: F9 tumor volume at day 16 after treatment start with different doses of anti-CCR8 antibody TPP-15285 or anti-PDL1 antibody. Significant improvement was observed at least for an antibody dose of 10 mg/kg.
Figure 54:
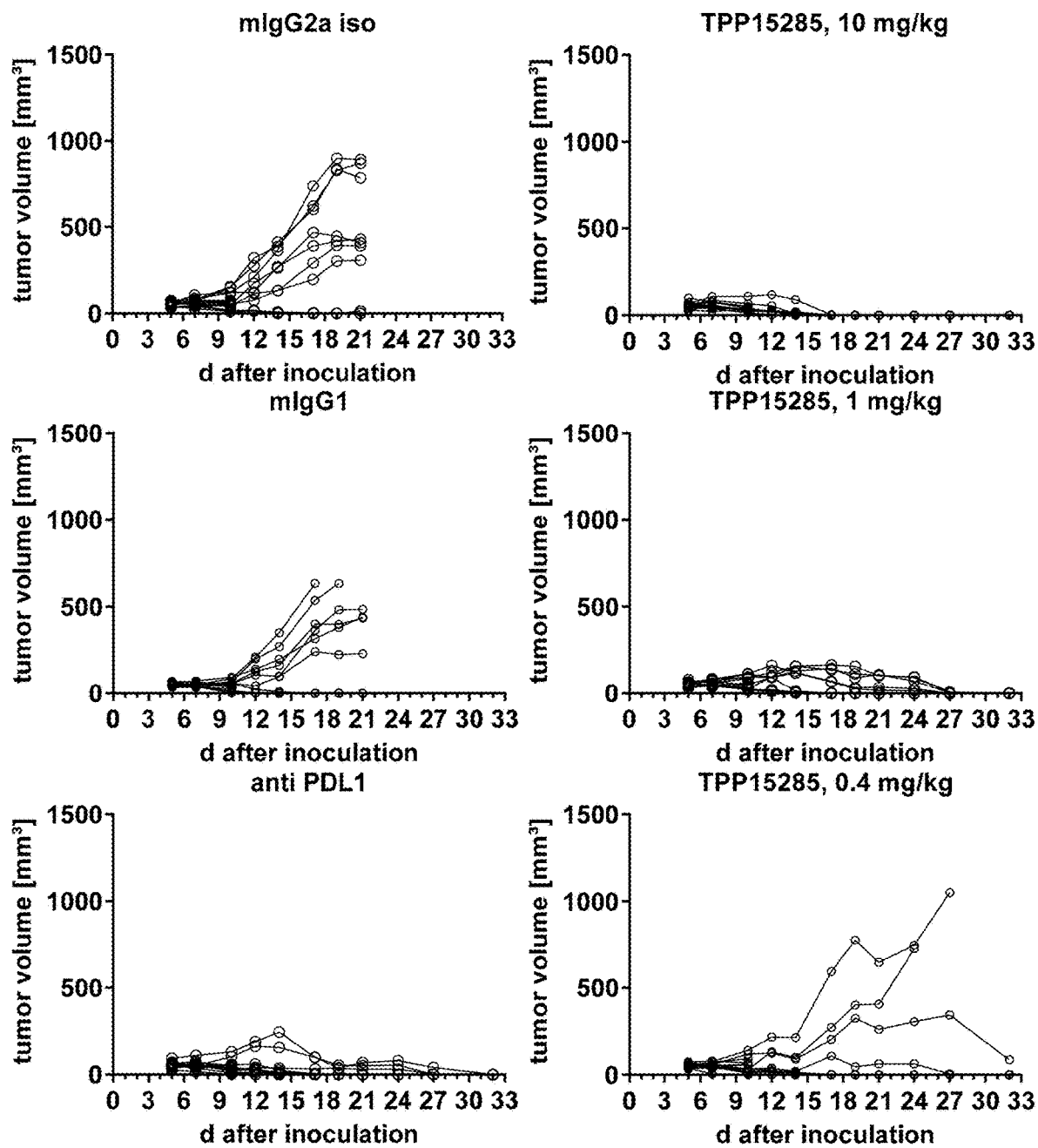
FIG. 54: Spider plots of F9 tumor bearing mice after treatment with different doses of anti-CCR8 antibodies or anti-PDL1 antibody.

Example 12.5: Efficacy of Anti-CCR8 Antibody TPP-15285 in F9 Tumor Bearing Mice The anti-CCR8 surrogate antibody TPP-15285 showed dose-dependent efficacy in F9 tumor bearing mice with strong effects in the 10 mg/kg and 1 mg/kg dose groups, but reduced efficacy in the 0.4 mg/kg dose group, comparable to the efficacy of anti-PD-L1 antibody (FIG. 52, FIG. 53). Spider plots illustrate these results on an individual mouse base (FIG. 54).

Figure 55:
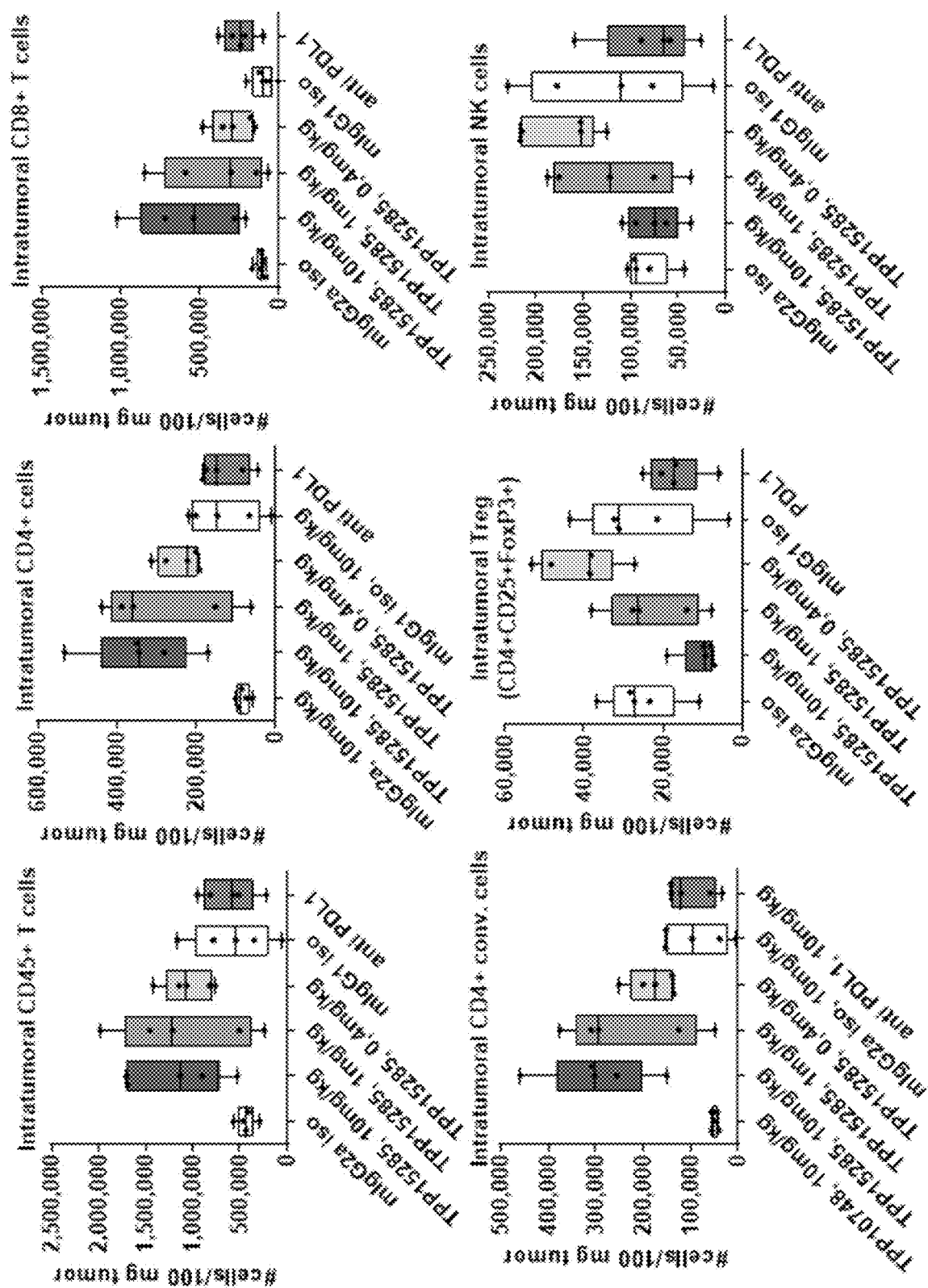
FIG. 55: Effects of anti-CCR8 antibodies or anti-PDL1 antibody on immune cell populations and their ratios in F9 tumors analyzed by FACS 24 hours after second antibody treatment. Anti-CCR8 antibody increased absolute numbers of intra-tumoral CD45+ T cells, intra-tumoral CD4+ T cells, intra-tumoral CD8+ T cells, intra-tumoral CD4+ conv T cells and intra-tumoral NK cells compared with the matched isotype control. Anti-CCR8 antibody at 10 mg/kg decreased absolute numbers of intra-tumoral Treg cells (CD4+, CD25+, FoxP3+).
Figure 56:
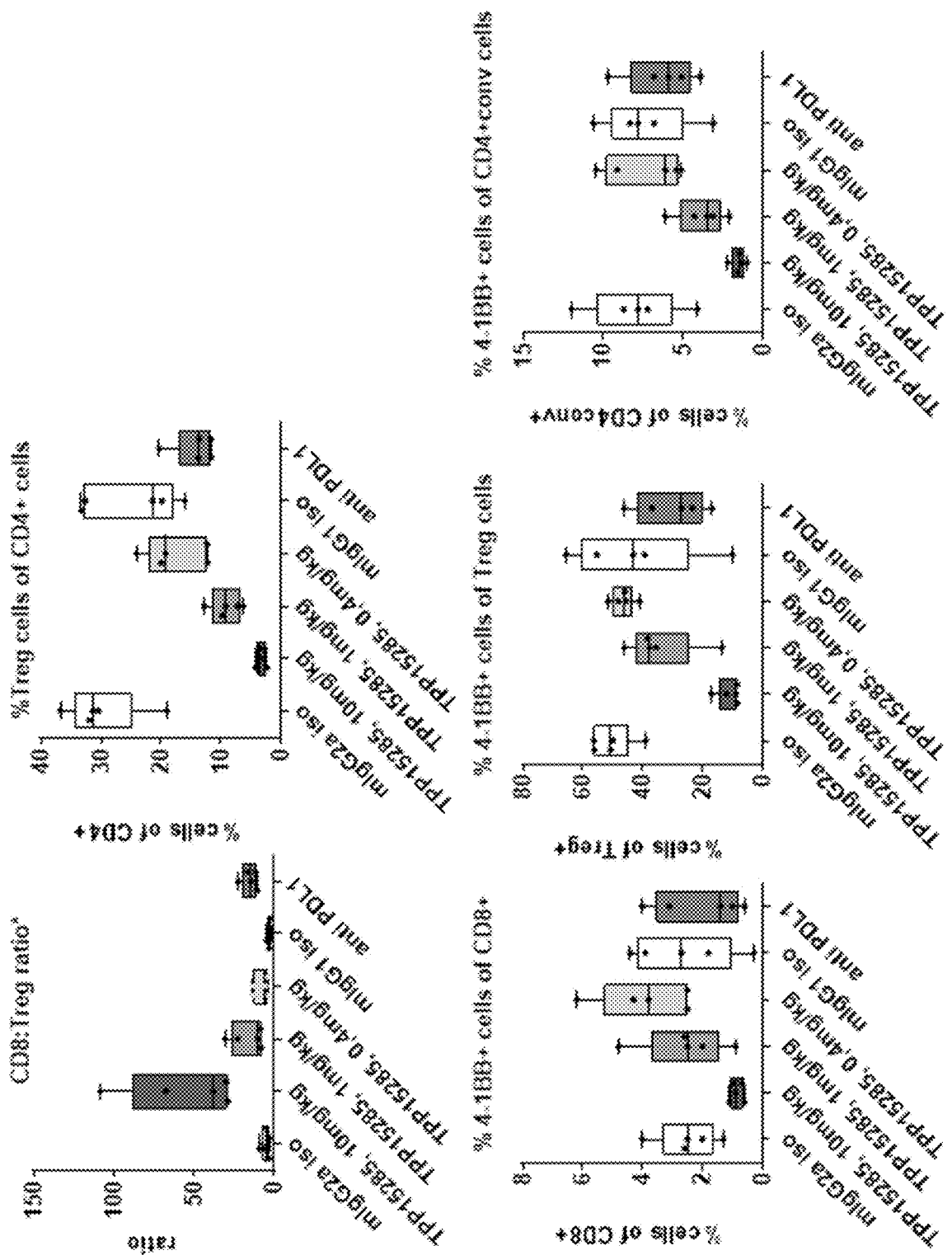
FIG. 56: Effects of anti-CCR8 antibodies or anti-PDL1 antibody on immune cell populations and their ratios in F9 tumors analyzed by FACS 24 hours after second treatment plotted as CD8+ T cell to Treg ratio, frequency of Treg to CD4+ T cells, frequency of 4-1BB+ cells of CD8+ T cells, frequency of 4-1BB+ cells of Tregs and frequency of 4-1BB+ cells of conventional CD4+ T cells. At 10 mg/kg anti-CCR8 antibody increased the CD8+ cell to Treg cell ratio to approximately 54 or higher, cf. Table 12.5.1.

Treg analysis of F9 tumor samples 24 hours after the second antibody treatment was performed by flow cytometry and showed strongly reduced numbers of Tregs in the 10 mg/kg dose anti-CCR8 antibody treated group versus the isotype control group. Treg depletion was clearly dose-dependent (FIG. 55). Treg depletion was also observed for anti-PD-L1 antibody treatment. Additionally, a strong and dose-dependent increase of CD8+ T cells in the tumors was demonstrated for all dose groups of TPP-15285 as well as for anti-PD-L1 antibody (FIG. 55). Further effects on various immune cell populations are shown in FIG. 55, FIG. 56 and Table 12.5.1.

TABLE 12.5.1

Effects of anti-CCR8 antibodies or anti-PDL1 antibody on immune cell populations and their ratios at 24 hours after second treatment.

| | mIgG2a iso | TPP15285, 10 mg/kg | TPP15285, 1 mg/kg | TPP15285, 0.4 mg/kg | mIgG1 iso | PDL1 |
|---|---|---|---|---|---|---|
| Mean # Tregs | 25324 | 10642 | 22734 | 41111 | 26435 | 17105 |
| % Tregs relative to iso ctrl | 100 | 42 | 90 | 162 | 100 | 65 |
| Mean # CD8+ T cells | 113947 | 553074 | 388731 | 291603 | 99850 | 246400 |
| % CD8+T cells relative to iso ctrl | 100 | 485 | 341 | 256 | 100 | 247 |
| Ratio CD8+ T cells:Tregs | 5.1 | 54.4 | 15.9 | 7.7 | 3.3 | 15.1 |
| Ratio CD4+ conv cells:Tregs | 2.2 | 28.5 | 9.6 | 4.6 | 3.0 | 5.7 |
| Mean # CD45+ | 435118 | 1191853 | 1080867 | 1042860 | 578616 | 615440 |
| % CD45+ cells relative to iso ctrl | 100 | 274 | 248 | 240 | 100 | 106 |
| Mean # CD4 cony cells | 49812 | 294714 | 230463 | 179896 | 89198 | 98995 |
| % CD4 cony cells relative to iso ctrl | 100 | 592 | 463 | 361 | 100 | 111 |
| Mean # CD4+ cells | 81866 | 335500 | 279725 | 240886 | 128434 | 126134 |
| % CD4+ T cells relative to iso ctrl | 100 | 410 | 342 | 294 | 100 | 98 |
| Mean # NK cells | 83353 | 75576 | 119531 | 172201 | 121590 | 79803 |
| % NK cells relative to iso ctrl | 100 | 91 | 143 | 207 | 100 | 66 |

Example 12.6: Efficacy of Anti-CCR8 Antibodies in Combination Therapy

Various experiments were performed to analyze the efficacy of anti-CCR8 antibodies alone or in combination with checkpoint targeting antibodies, such as anti-PD-L1, anti-PD1, and anti-CTLA4 antibodies. Combination with these checkpoint targeting molecules was found to provide additional efficacy. In addition, further combination treatments were evaluated, e.g. with chemotherapeutic agents such as oxaliplatin, doxorubicin, gemcitabine or radiation therapy. Table 12.6.1 summarizes the results for different combination treatments. Additional benefit was observed, if the treatment with the second therapeutic agent was started only after the start of treatment with anti-CCR8 antibody.

TABLE 12.6.1

Anti-CCR8 antibody combination treatments and results.

Figure 68:
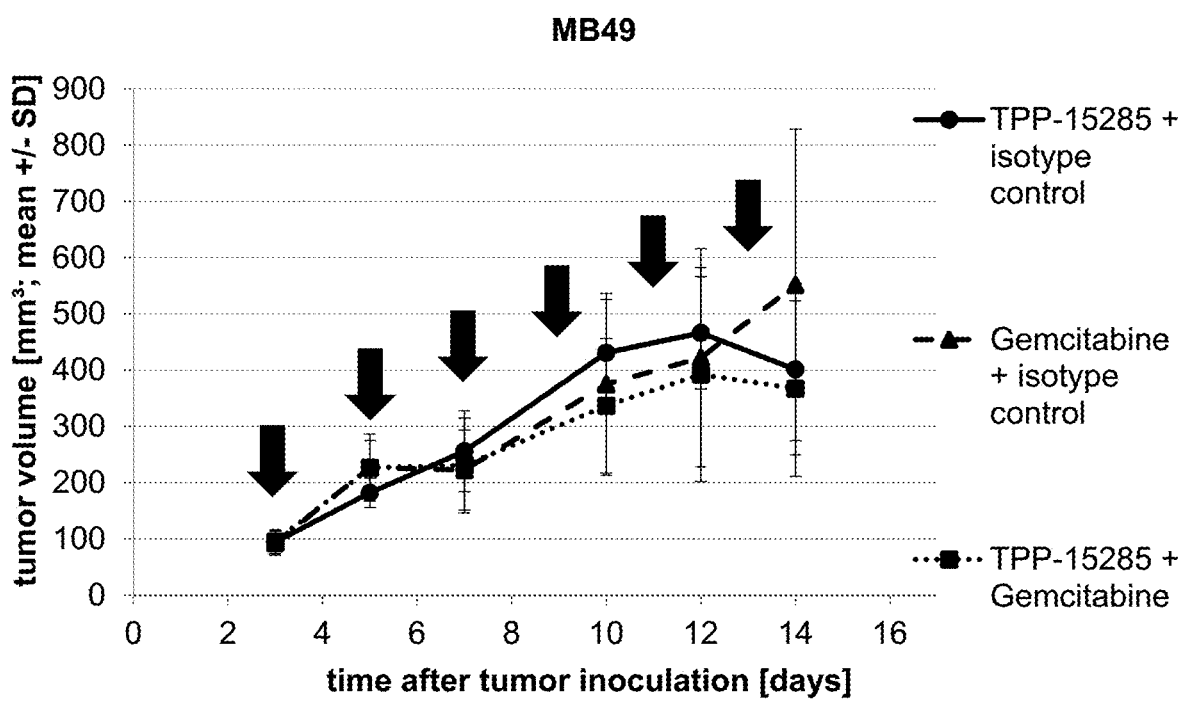
FIG. 68: MB49 tumor growth after treatment with anti-CCR8 antibody TPP-15285, gemcitabine or a combination of TPP-15285 with gemcitabine.

| Tumor model [Example] | Combination treatment | Results | Further benefit |
|---|---|---|---|
| C38 [12.6.1] | TPP-15285 (10 mg/kg) Anti-PD-L1 ab (3 mg/kg) | CR combo: 8/10; CR anti-CCR8 ab mono: 3/10; CR anti-PD-L1 ab mono: 0/10 | ++ |
| CT26 (large tumors) [data not shown] | TPP-15285 (10 mg/kg) Anti-PD-L1 ab (10 mg/kg) | T/C combo: 0.45; T/C anti-CCR8 ab mono: 0.57; T/C anti-PD-L1 ab mono: 0.79 | + |
| B16F10-OVA [12.6.2] | TPP-15285 (10 mg/kg) Anti-CTLA4 ab (10 mg/kg) | T/C combo: 0.13; T/C anti-CCR8 ab mono: 0.37; T/C anti-CTLA4 ab mono: 0.30 | ++ |
| EMT-6 [12.6.3] | TPP-15285 (1 mg/kg) Anti-PD-1 ab (10 mg/kg) | Synergistic efficacy in combination; no efficacy in monotherapy | ++ |
| C38 (survival) [12.6.4] | TPP-15285 (5 mg/kg) Anti-PD-1 ab (5 mg/kg) | CR combo: 10/10; CR anti-CCR8 ab mono: 9/10; CR anti-PD-1 ab mono: 4/10 | ++ |
| MB49 [12.6.5] | TPP-15285 (10 mg/kg) Anti-PD-1 ab (10 mg/kg) combo start after CCR8 treatment | T/C combo: 0.16; T/C anti-CCR8 ab mono: 0.37; T/C anti-PD1 ab mono: 0.63 | ++ |
| EMT-6 [12.6.6] | TPP-15285 (5 mg/kg) Oxaliplatin (5 mg/kg) Doxorubicin (6 mg/kg) Docetaxel (10 mg/kg) | T/C (day: 19) anti-CCR8 ab mono: 0.20 Oxaliplatin mono: 0.61 Doxorubicin mono: 0.43 Docetaxel mono: 0.50 Combo with Oxaliplatin: 0.26 Combo with Doxorubicin: 0.19 Combo with Docetaxel: 0.20 Combo: synergistic effects in final tumoral CD8/Treg ratio as well as in frequency of activated CD8+ CD25+ T cells in the blood | + |
| Lewis Lung [12.6.7] | TPP-15285 (10 mg/kg) Anti-PD-1 ab (10 mg/kg) Anti-PD-L1 ab (10 mg/kg) Anti-CTLA4 ab (10 mg/kg) combo start after anti-CCR8 ab treatment | T/C (day: 25) Combo with aPD-1: 0.67* Combo with aPD-L1: 0.93 anti-CCR8 ab mono: 0.78 anti-PD-1 mono: 0.91 anti-PD-L1 mono: 0.96 anti-CTLA4 mono: 1.10 * increased CD8+ frequency and CD8/Treg ratio at study end | + |
| MB49 [FIG. 68] | TPP-15285 (10 mg/kg) Anti-PD-1 ab (10 mg/kg) Anti-PD-L1 ab (10 mg/kg) Gemcitabine (100 mg/kg) combo start after CCR8 treatment | T/C (day: 14) Combo with aPD-L1: 0.35 Combo with aPD-1: 0.37 Combo with Gemcitabine: 0.56 anti-CCR8 ab mono: 0.61 anti-PD-L1 ab mono: 0.67 anti-PD-1 ab mono: 0.79 Gemcitabine mono: 0.73 | ++ |
| EMT-6 [12.6.8] | TPP-15285 (3 mg/kg) 3 × 2 Gy Radiotherapy | Combo: 0.42 3 × 2 Gy alone: 0.80 anti-CCR8 ab mono: 0.54 | ++ |
| MBT2 [12.6.9] | TPP-15285 (10 mg/kg) Anti-PD-L1 ab (10 mg/kg) Anti-PD-1 ab (10 mg/kg) Paclitaxel (10 mg/kg, q4d, i.v.) | T/C (day: 24) Combo with aPD-L1 ab: 0.41 Combo with aPD-1 ab: 0.15 Combo with Paclitaxel: 0.39 anti-CCR8 ab mono: 0.5 anti-PD-L1 ab mono: 0.89 anti-PD-1 ab mono: 0.66 Paclitaxel mono: 0.83 | ++ |

These results demonstrate the beneficial impact of combining anti-CCR8 antibody treatment with further therapeutically active agents. The inventors furthermore conclude that the sequential administration of the therapeutic agents adds additional benefit, if the anti-CCR8 antibody is administered first and if a further therapeutic agent is administered only after an initial reduction of Treg cells (e.g. by at least 50%) has taken place, e.g. as demonstrated in examples 12.6.5 and 12.6.7.

In view of these experiments and results the inventors are convinced that triple combination, e.g. with an anti-CCR8 antibody, an antibody targeting a checkpoint protein and a targeted therapeutic agent (small molecules as well as antibodies) provides further benefit in survival due to the differences in the modes of action of these treatments. Therefore, the combination of an anti-CCR8 antibody with a checkpoint targeting antibody and a tumor cell targeting antibody or agent is suggested for tumor treatment. In a preferred embodiment, the combination is a combination of a CCR8 antibody, an anti-PD(L)-1 antibody and paclitaxel.

Figure 57:
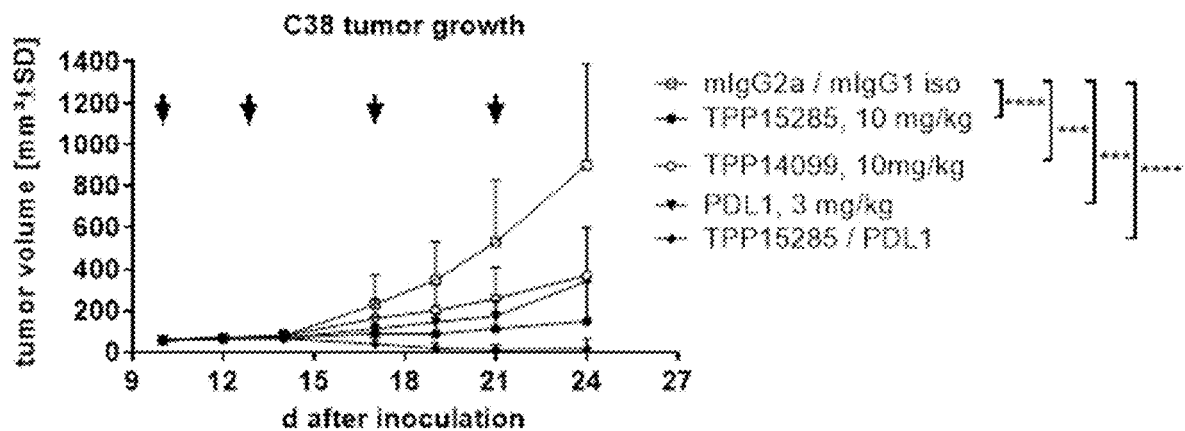
FIG. 57: Efficacy of combination treatments in C38 tumor bearing mice. a. C38 tumor growth after treatment with anti-CCR8 surrogate antibodies TPP-14099 or TPP-15285 or anti-PD-L1 antibody or after combination treatment with 3 mg/kg anti-PDL1 antibody, 10 mg/kg TPP-15285. Significance as determined by 1-Way ANOVA plus Sidak's post-test after log transform. b. Survival plot of C38-tumor bearing mice after treatment with anti-murine CCR8 antibody TPP-15285 (10 mg/kg), anti-murine PD-L1 antibody (PDL1, 3 mg/kg) or a combination of TPP-15285 (10 mg/kg) and anti-murine PD-1 antibody (3 mg/kg).
Figure 57:
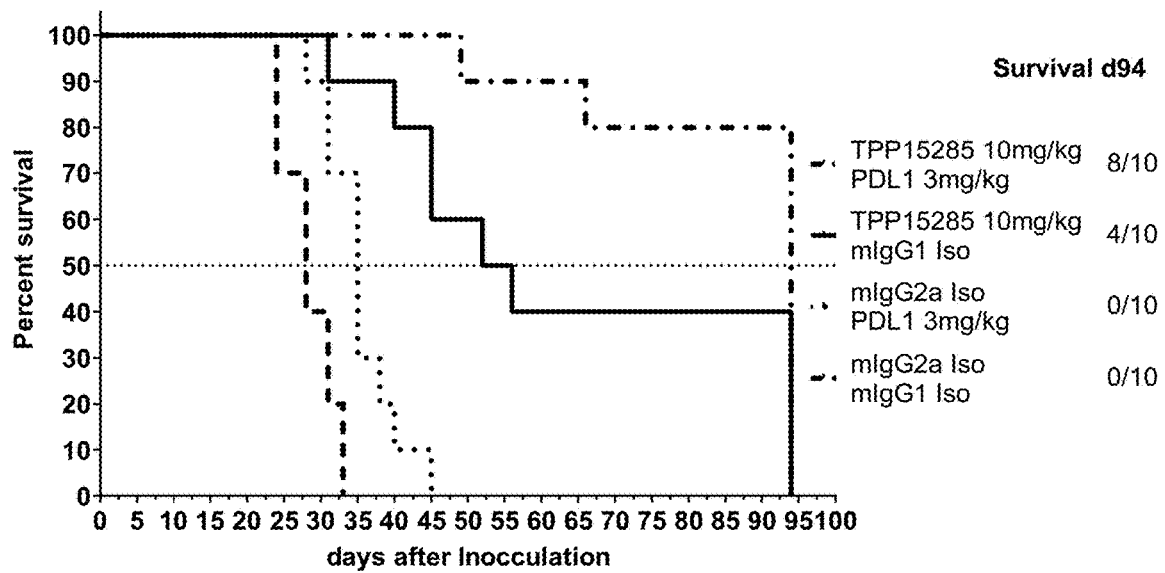

Example 12.6.1: Efficacy of Anti-CCR8 Antibodies in C38 Tumor Bearing Mice & Combination Therapy with Anti-PD-L1 Antibody The anti-CCR8 surrogate antibodies TPP-14099 and TPP-15285 showed strong efficacy in C38 tumor bearing mice, comparable to the efficacy of anti-PD-L1 antibody (FIG. 57 a). Combination of TPP-15285 with 3 mg/kg anti-PD-L1 antibody showed further improved efficacy. Both antibodies were formulated separately in phosphate buffered saline and were applied as in total four individual intraperitoneal injections twice weekly, i.e. in combination at the same day with a simultaneous treatment start.

Mice were monitored in a survival study over 94 days (FIG. 57 b). Remarkably, 8 out of 10 mice treated with combination of anti-CCR8 antibody and anti-PD-L1 antibody survived day 94, 4 out of 10 mice treated with CCR8 antibody TPP-15285 alone survived day 94, and none of the mice treated with anti-PD-L1 antibody alone survived day 94, demonstrating a synergistic efficacy of anti-CCR8 antibody and PD-L1 antibody. C38 is a low infiltrated syngeneic mouse model which uses C38 colon cancer cells for tumor induction. The model is generally considered responsive to anti PD-L1 antibody treatment. In view of the available data described herein, the stratification of patients based on T cell infiltration and/or response to PD-L1 therapy is suggested to provide additional benefit.

Treg analysis of C38 tumor samples 24 hours after the second antibody treatment by flow cytometry showed strongly reduced numbers of Tregs in the anti-CCR8 antibody treated groups versus isotype control group (FIG. 58). The strongest Treg depletion was observed for the combination of TPP-15285 with anti-PD-L1 antibody. Additionally, the highest CD8+/Treg ratio was observed for the combination of TPP-15285 with anti-PD-L1 antibody. Interestingly, analysis of macrophages showed an increase at day 24 of the study (FIG. 59).

Figure 60:
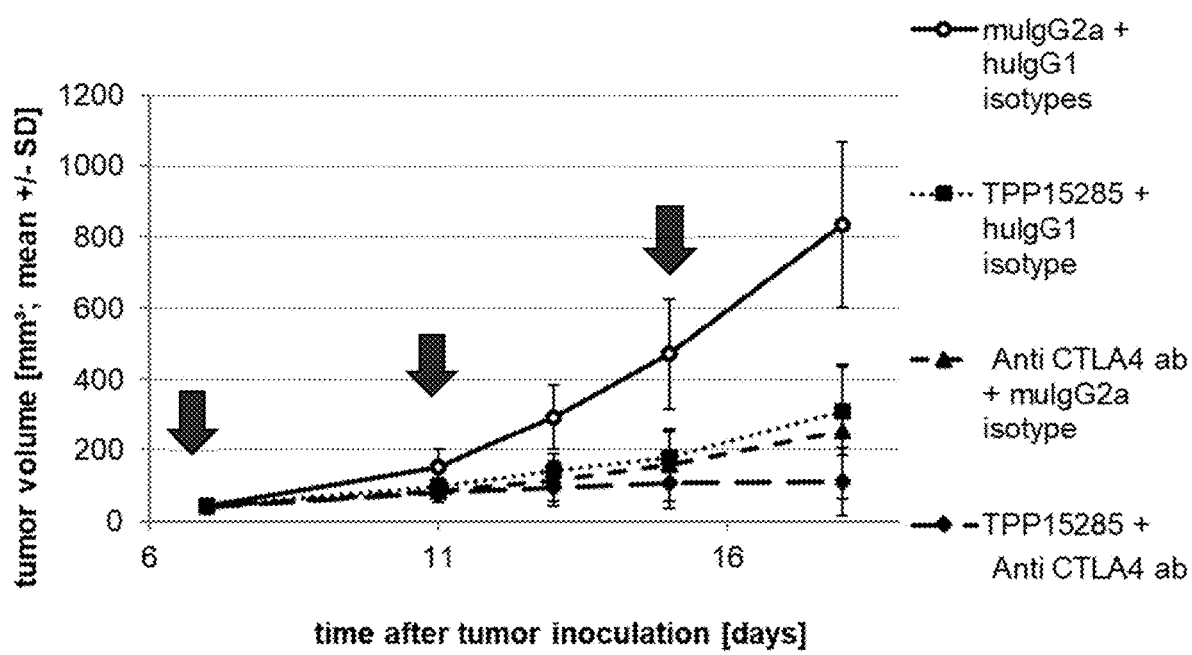
FIG. 60: B16F10-OVA tumor growth after treatment with TPP-15285, anti-CTLA4 antibody or both.

Example 12.6.2: Efficacy of Anti-CCR8 Antibodies in B16F10-OVA Tumor Bearing Mice & Combination Therapy with Anti-CTLA4 Antibody The anti-CCR8 antibody TPP-15285 (10 mg/kg) showed strong efficacy in B16F10-OVA bearing mice comparable to the efficacy of an anti-CTLA4 antibody (10 mg/kg) (FIG. 60). Combination of TPP-15285 with anti-CTLA4 antibody showed synergistic efficacy, correlating with an increase of CD8+ T cells and IFNg/TNFa levels.

Both antibodies were formulated in PBS and were applied as in total three individual intraperitoneal injections twice weekly, in combination at the same day with a simultaneous treatment start.

Treg analysis of B16F10-OVA tumor samples 24 hours after the second antibody treatment (day 12) by flow cytometry showed strongly reduced numbers of Tregs in the CCR8-antibody treated groups versus the isotype control group (Table 12.6.2.1). The strongest Treg depletion was observed for the combination of TPP-15285 with anti-CTLA4 antibody. Additionally, the strongest CD8+ T cell increase was observed for the combination of TPP-15285 with anti-CTLA4 antibody.

FACS analysis of B16F10-OVA-tumors 24 hours after second antibody treatment with TPP-15285+isotype control, anti-CTLA4 antibody+isotype control or TPP-15285+anti-CTLA4 antibody demonstrated a decrease of intra-tumoral Treg frequency and an increase of absolute numbers of CD8+ T cells.

TABLE 12.6.2.1

| | Intra-tumoral cell populations determined by FACS and IFNg determined by ELISA at the study end. | | | |
|---|---|---|---|---|
| | mulgG2a + hulgG1 isotypes | TPP15285 + hulgG1 isotype | aCTLA4 + mulgG2a isotype | TPP15285 + aCTLA4 |
| absolute CD45 | 199442.1 | 437004.9 | 611423.6 | 717324.5 |
| absolute CD8 | 25327.0 | 155532.5 | 220147.5 | 312653.9 |
| absolute Treg | 6261.1 | 9148.6 | 15413.2 | 11448.3 |
| abs NK+ | 11066.6 | 36950.0 | 65954.0 | 57789.1 |
| % NK+ | 5.9 | 8.1 | 10.1 | 7.6 |
| % CD8 | 14.6 | 34.8 | 36.5 | 42.7 |
| % Treg | 31.58 | 18.86 | 23.2 | 8.98 |
| IFNg (pg/ml per mg protein) | 3.80 | 28.83 | 18.40 | 35.70 |

*mean for n = samples.

Example 12.6.3: Combination Treatment with Anti-PD-1 Antibody and Anti-CCR8 Antibody in EMT-6 Tumor Bearing Mice: Synergistic Efficacy The therapeutic efficacies of anti-murine CCR8 antibody TPP-15285 (1 mg/kg) alone, anti-murine PD-1 antibody (CDRs: atezolizumab, 10 mg/kg) alone or combination of TPP-15285 (1 mg/kg) and anti-murine PD-1 antibody (10 mg/kg) were evaluated in EMT-6 tumor bearing mice. Both antibodies were formulated in PBS and applied as in total four individual intraperitoneal injections twice weekly, in combination at the same day with a simultaneous treatment start.

Figure 61:
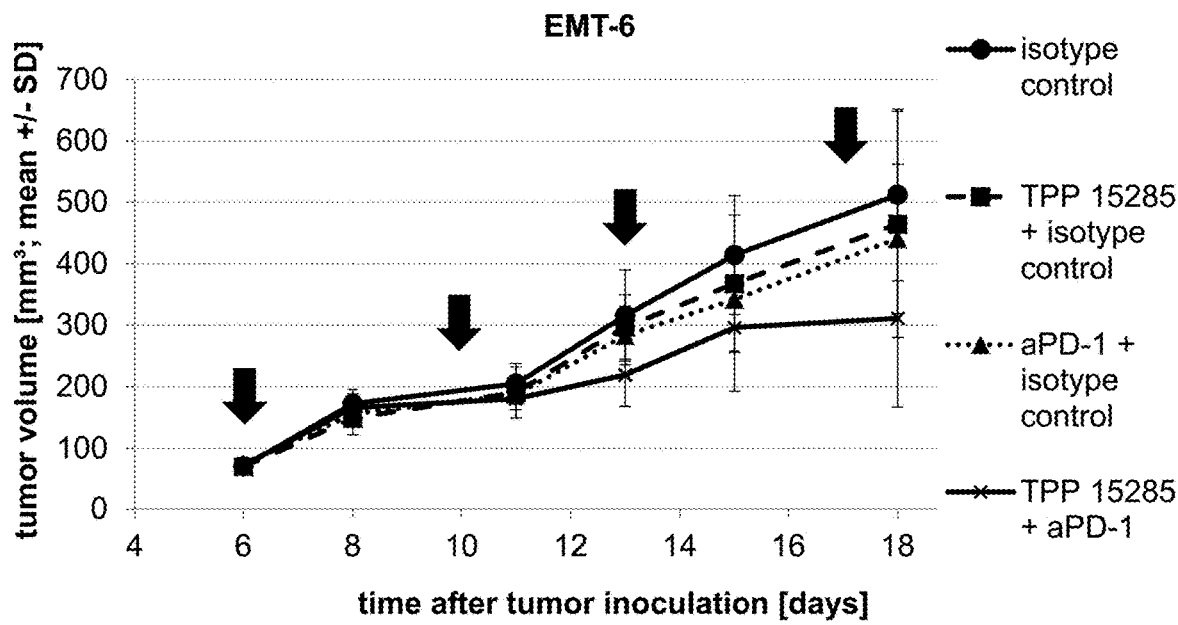
FIG. 61: EMT-6 tumor growth after treatment with anti-murine CCR8 antibody TPP-15285 (1 mg/kg), anti-murine PD-1 antibody (CDRs: atezolizumab, 10 mg/kg) or a combination of TPP-15285 (1 mg/kg) and anti-murine PD-1 antibody (10 mg/kg), (twice weekly i.p.). Mean with standard deviation.

The anti-CCR8 antibody TPP-15285 showed weak efficacy in EMT-6 bearing mice at a low dose of 1 mg/kg, comparable to the weak efficacy of anti-PD-1 antibody at 10 mg/kg (FIG. 61). Combination of 1 mg/kg TPP-15285 with 10 mg/kg anti-PD-1 showed synergistic efficacy.

Figure 62:
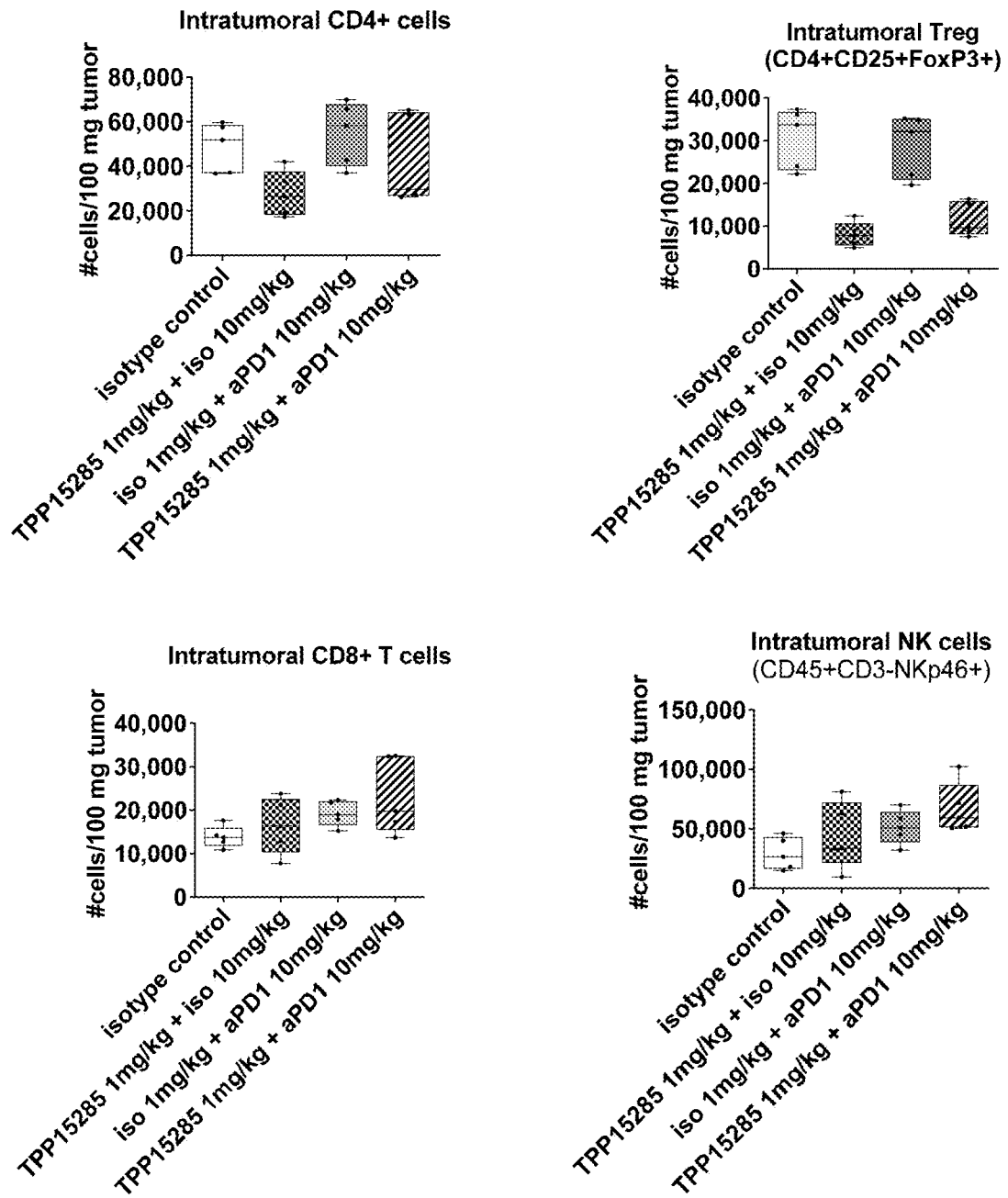
FIG. 62: FACS analysis of immune cell populations in EMT-6-tumors analyzed by flow cytometry, sampling 24 hours after second antibody treatment. CD4+ T cells, Tregs, CD8+ T cells, NK cells, Ratios of CD8+ T cells to Tregs. Box and whiskers, min to max with median (GraphPad).
Figure 62:
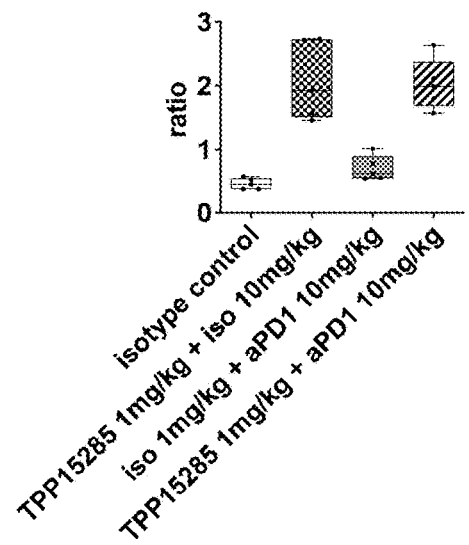

Treg analysis of EMT-6 tumor samples 24 hours after the second antibody treatment by flow cytometry showed strongly reduced numbers of Tregs in the CCR8-antibody treated groups versus the isotype control group or anti-PD-1 monotherapy (FIG. 62).

TABLE 12.6.3.1

Intra-tumoral cell populations determined by FACS in EMT-6 tumors at the study end.

| Intra-tumoral immune cells | isotype control | TPP15285 + isotype control | Anti-PD1 ab + isotype control | TPP15285 + anti-PD1 ab |
|---|---|---|---|---|
| CD4+ (*) | 48583.4 | 27646.1 | 54791.8 | 42312.3 |
| Tregs (CD4+ CD25+ FoxP3+) (*) | 30686.4 | 7998.8 | 28781.7 | 11506.9 |
| CD8+ T-cells (*) | 13825.7 | 16398.8 | 19233.3 | 23132.7 |
| NK cells (CD45+ CD3+ NKp46+) (*) | 29119.6 | 44152.1 | 51372.0 | 67155.1 |
| CD8: Treg ratio | 0.5 | 2.1 | 0.7 | 2.0 |

* mean for n = samples, cells/100 mg tumor.

Example 12.6.4: Combination Treatment with Anti-PD-1 Antibody and Anti-CCR8 Antibody in C38 Tumor Bearing Mice The therapeutic efficacies of anti-murine CCR8 antibody TPP-15285 (5 mg/kg) alone, anti-murine PD-1 antibody (aPD-1, CDRs: atezolizumab, 5 mg/kg) alone or combination of TPP-15285 (5 mg/kg) and anti-murine PD-1 antibody (5 mg/kg) were evaluated in C38 tumor bearing mice. Both antibodies were formulated in PBS and applied as in total four individual intraperitoneal injections twice weekly, in combination at the same day with a simultaneous treatment start.

Figure 63:
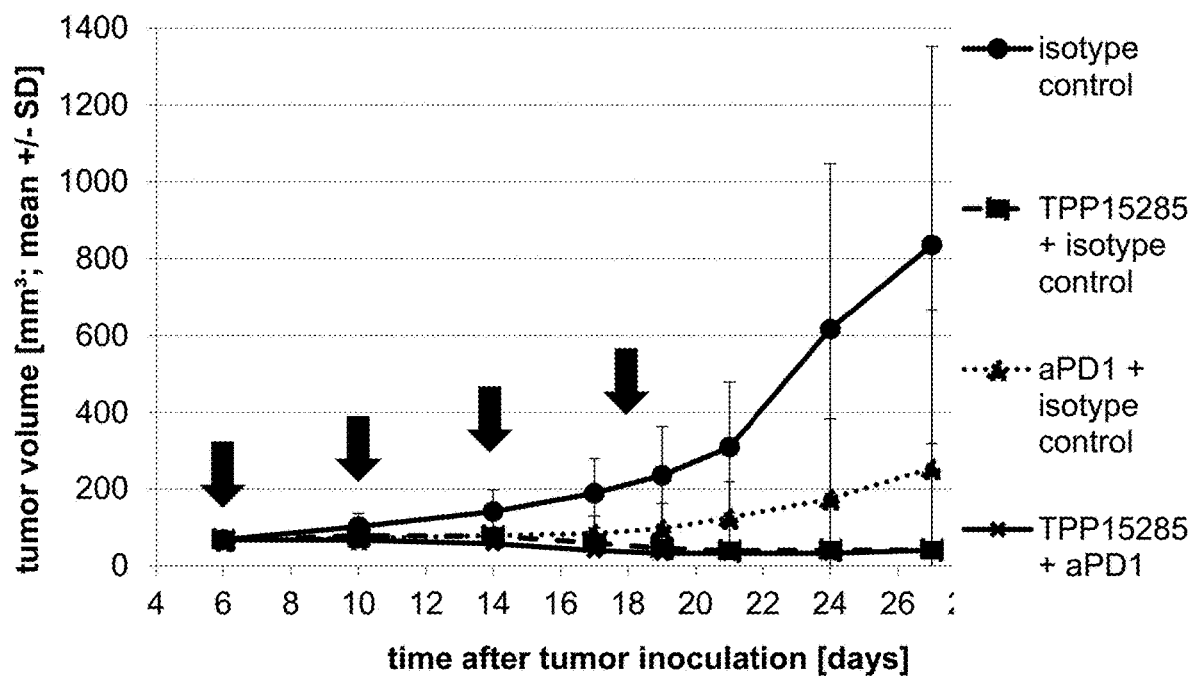
FIG. 63: a. Analysis of C38 tumor bearing mice after treatment with anti-murine CCR8 antibody TPP-15285 (5 mg/kg), anti-murine PD-1 antibody (CDRs: atezolizumab, 5 mg/kg) or a combination of TPP-15285 (5 mg/kg) and anti-murine PD-1 antibody (5 mg/kg), (each twice weekly i.p.). a. Tumor volume. Mean with standard deviation. b. Survival plot.
Figure 63:
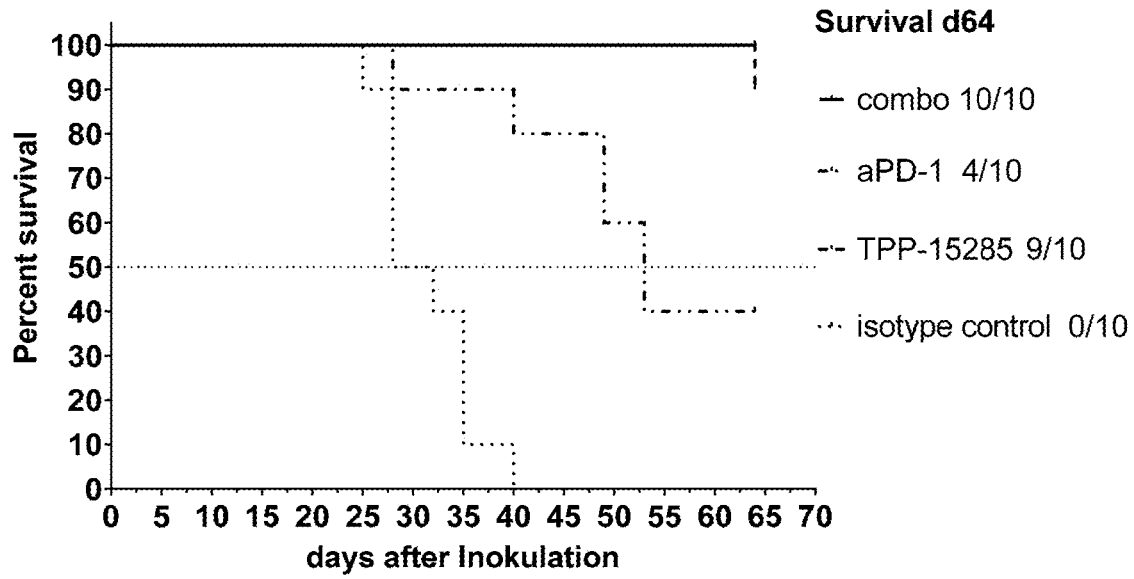

The anti-CCR8 antibody TPP-15285 showed a strong efficacy in C38 tumor bearing mice which was higher than the efficacy of an anti-PD-1 antibody administered at the same dose (FIG. 63 *a*). After 64 days, combination of 5 mg/kg TPP-15285 with 5 mg/kg anti-PD-1 antibody showed improved efficacy in survival with 10/10 complete responders compared to 9/10 for anti-CCR8 monotherapy and 4/10 for anti-PD1 monotherapy (FIG. 63 *b*).

Figure 64:
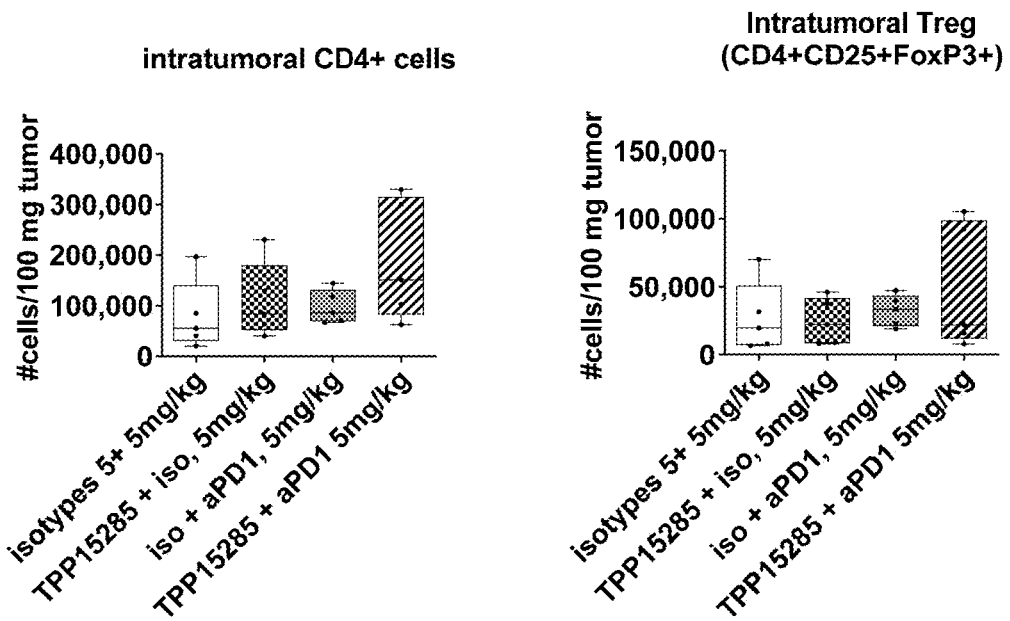
FIG. 64: Analysis of tumoral CD4+ T cells, Tregs, CD8+ T cells, NK cells or ratios of CD8+ T cells to Tregs in C38-tumors by flow cytometry (sampling 24 hours after second antibody treatment).
Figure 64:
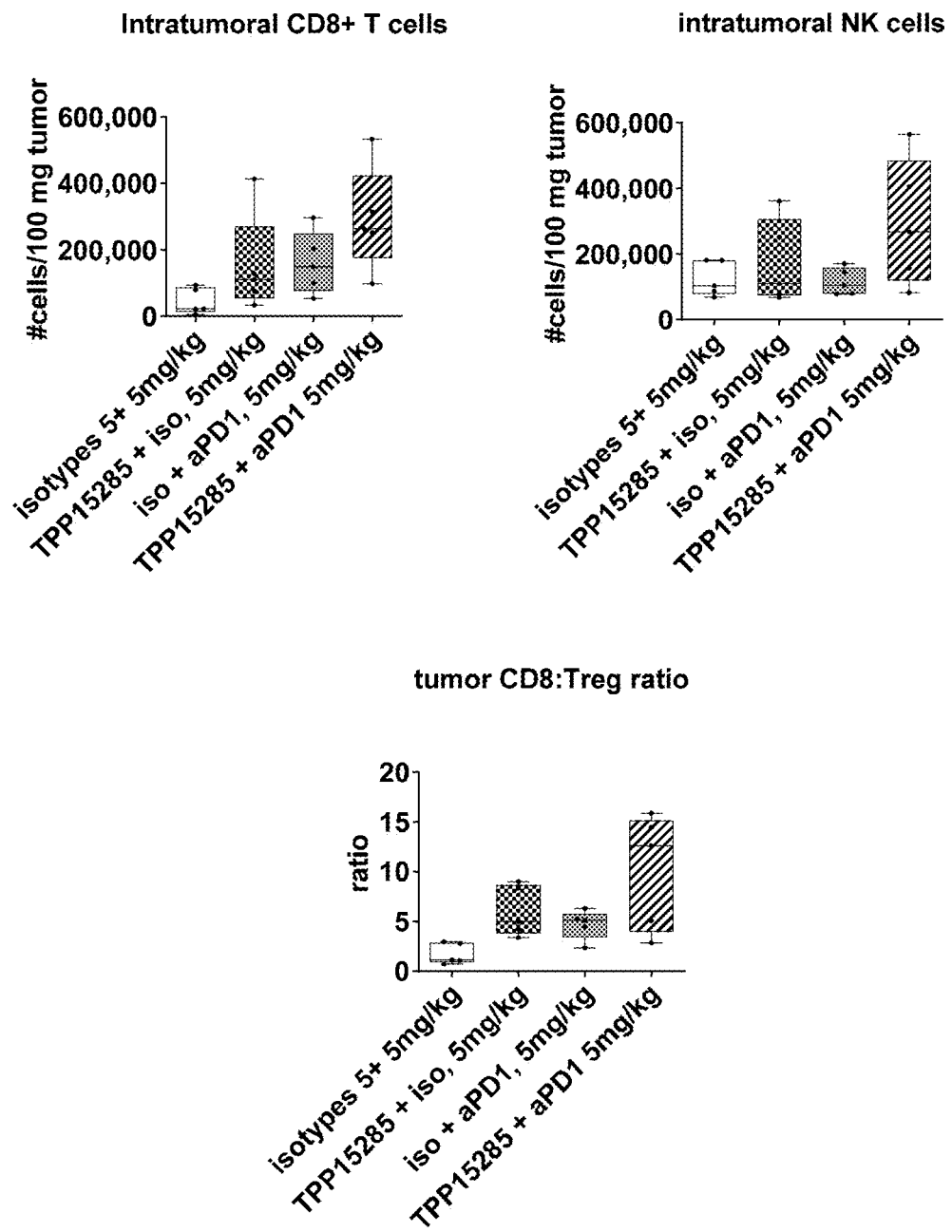

Treg analysis of C38 tumor samples 24 hours after the second antibody treatment by flow cytometry are shown in FIG. 64, Table 12.6.4.1.

Figure 65:
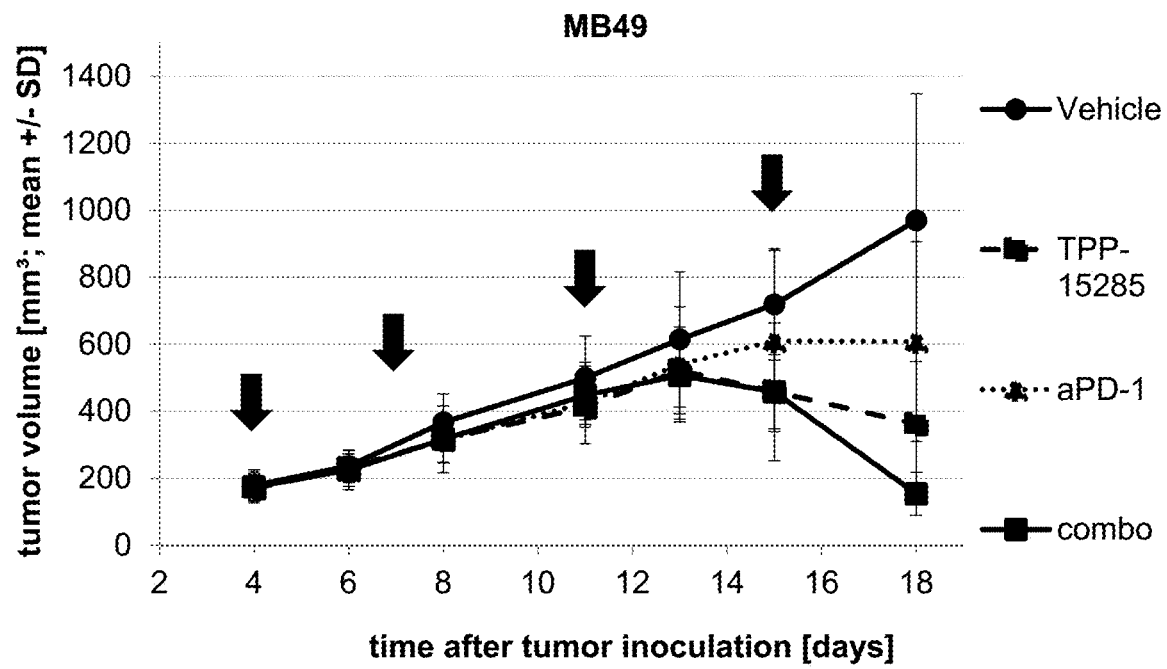
FIG. 65: MB49 tumor growth after treatment with anti-CCR8 antibody TPP-15285 (10 mg/kg) alone, anti-PD-1 antibody (aPD-1, CDRs: atezolizumab, 10 mg/kg) alone or sequential combination treatment of TPP-15285 (10 mg/kg) and anti-PD-1 antibody (10 mg/kg) (both twice weekly i.p.).

Example 12.6.5: Sequential Combination Treatment of Anti-CCR8 Antibody with Anti-PD-1 Antibody in MB49 Tumor Bearing Mice The therapeutic efficacy of anti-murine CCR8 antibody TPP-15285 (10 mg/kg) alone, anti-murine PD-1 antibody (CDRs: atezolizumab, 10 mg/kg) alone and combination of TPP-15285 (10 mg/kg) and anti-PD-1 antibody (10 mg/kg) was evaluated in a study in MB49-tumor bearing mice. In this study, the first dose of anti-PD1 antibody was administered only after anti-CCR8 antibody, i.e. after allowing the anti-CCR8 antibody to cause an effect on Tregs leading to an increased CD8+ T cell to Treg ratio. More specifically, treatment with anti-PD1 antibody was started 24 hours after the second anti-CCR8 antibody treatment. Anti-CCR8 antibody TPP-15285 showed a strong efficacy in MB49 tumor bearing mice that was also higher than for anti-PD1 antibody (FIG. 65). Combination of 10 mg/kg TPP-15285 with 10 mg/kg anti-PD-1 showed further improved efficacy.

Figure 66:
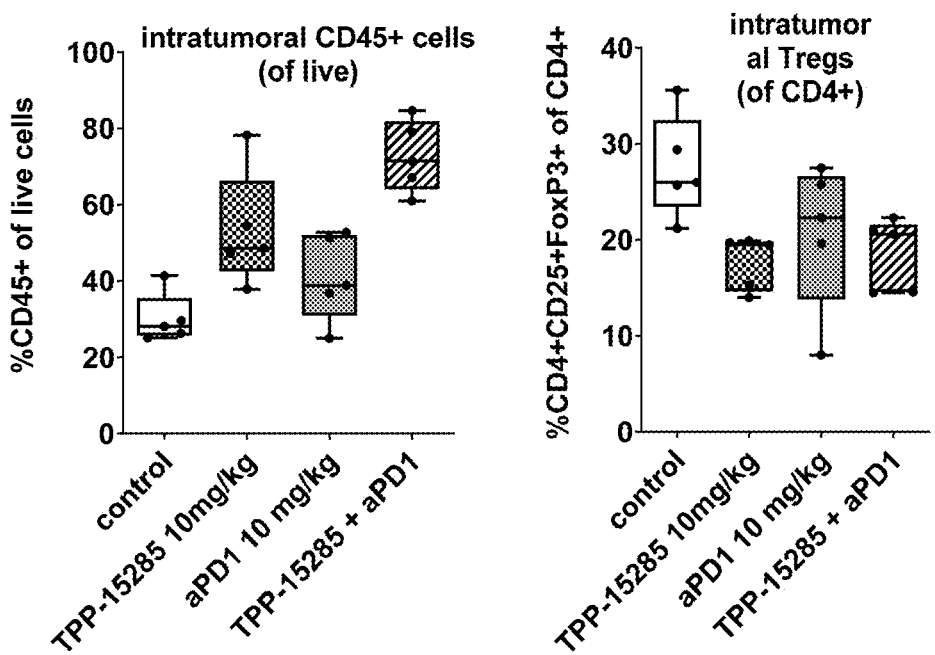
FIG. 66: Analysis of tumoral CD45+ cells, Tregs, CD8+ T cells, NK cells and ratio of CD8 to Tregs in MB49-tumors by flow cytometry (sampling at study end).
Figure 66:
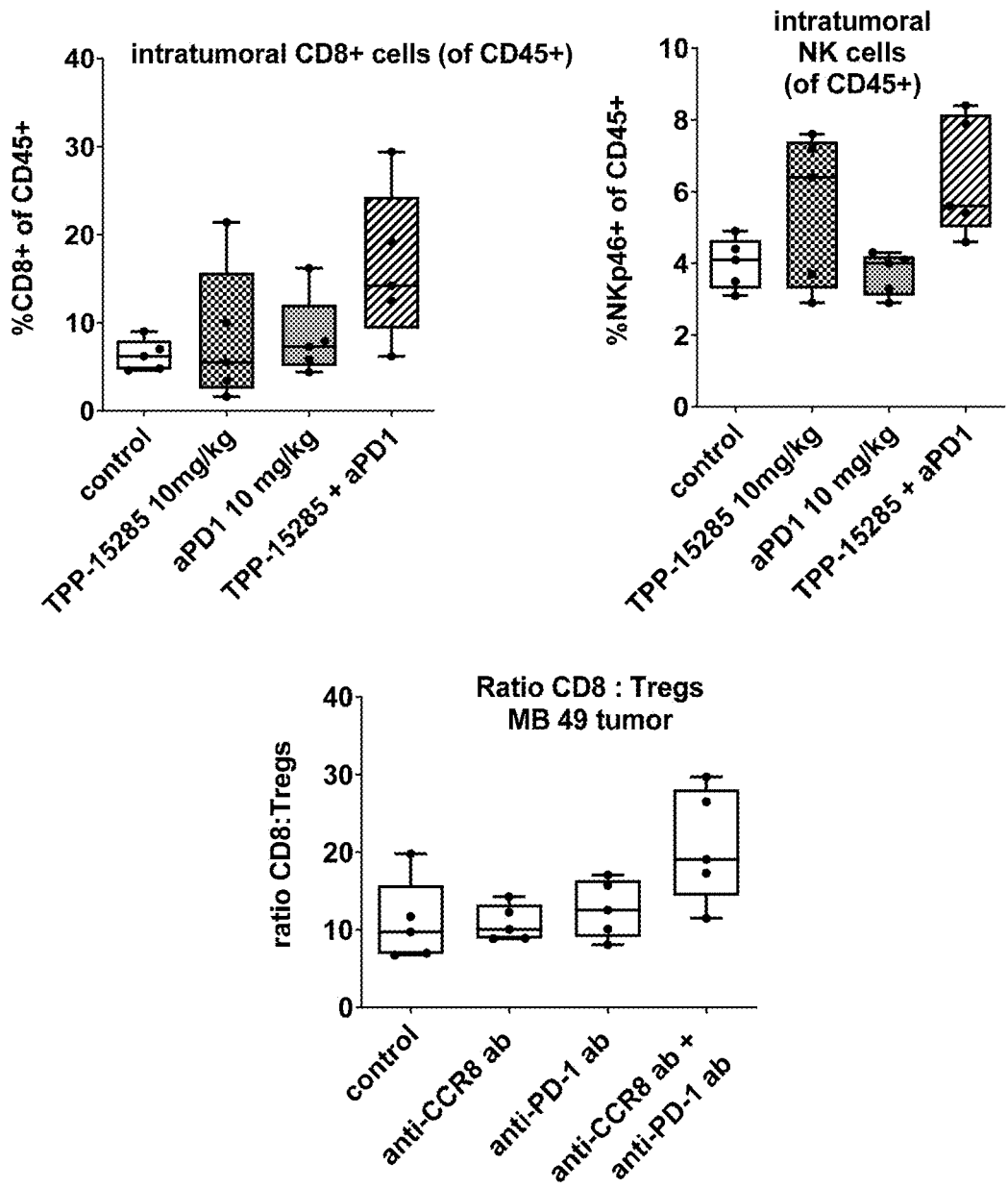

FACS analysis of MB49-derived tumor samples at the study end showed increased CD45+ cell, CD8+ cell and NK cell frequency and reduced frequency of Tregs in the anti-CCR8 antibody treated groups versus vehicle control group or anti-PD-1 antibody monotherapy (FIG. 66, Table 12.6.5.1).

MB49 is a medium infiltrated syngeneic model using bladder cancer cells which is responsive to immune checkpoint inhibitor (ICI) therapy. In view of these data, the stratification of subjects for low immune infiltration and/or response to ICI therapy is suggested to provide additional benefit for this combination therapy.

In particular, the start of combination treatment after anti-CCR8 antibody treatment was found to provide a ben-

TABLE 12.6.4.1

Intra-tumoral cell populations determined by FACS in C38 tumors 24 hours after the second antibody treatment.

| Intra-tumoral immune cells | isotype control | TPP15285 + isotype control | Anti-PD1 ab + isotype control | TPP15285 + Anit-PD1 ab |
|---|---|---|---|---|
| CD4+ (*) | 79735.2 | 109508.8 | 97352.8 | 189350.0 |
| Tregs (CD4+ CD25+ FoxP3+) (*) | 27132.4 | 24495.8 | 32360.0 | 48581.6 |
| CD8+ T-cells (*) | 44063.8 | 151644.0 | 160225.4 | 291992.8 |
| NK cells (CD45+ CD3+ NKp46+) (*) | 124067.0 | 173865.5 | 115642.8 | 295252.5 |
| CD8: Treg ratio | 1.7 | 6.0 | 4.7 | 10.2 |

* mean for n = samples, cells/100 mg tumor.

efit. Without being bound by theory, the inventors assume that initial depletion of Tregs by CCR8 antibodies enhances the activity of antigen-presenting cells and priming of tumoral T cells resulting in improved sensitivity for checkpoint inhibitors such as PD-(L)1, because Tregs as tumor-cell extrinsic factors play a role for primary and adaptive resistance to checkpoint inhibitors in cancer patients.

TABLE 12.6.5.1

Intra-tumoral cell populations determined by FACS in MB49 tumors at the study end.

| Intra-tumoral immune cells | isotype control | TPP15285 | Anti-PD1 ab | TPP15285 + anti-PD1 ab |
|---|---|---|---|---|
| CD45+ cells (in % of live) | 30.1 | 53.2 | 40.9 | 72.7 |
| Tregs (CD4+ CD25+ FoxP3+ cells in % of CD4+ cells) (*) | 27.6 | 17.7 | 20.6 | 18.6 |
| CD8+ cells (in % of CD45+) | 6.3 | 8.4 | 8.3 | 16.3 |
| NK cells (NKp46+ cells in % of CD45+ cells) | 4.0 | 5.6 | 3.7 | 6.4 |
| CD8: Treg ratio | 11.0 | 10.9 | 12.7 | 20.8 |

* mean for n = samples, cells/100 mg tumor.

Example 12.6.6: Combination Treatment Comprising Anti-CCR8 Antibody and Chemotherapy in EMT-6 Tumor Bearing Mice The therapeutic efficacies of anti-CCR8 antibody TPP-15285 (5 mg/kg, q3/4d i.p.) alone, Oxaliplatin (5 mg/kg, q4d i.p.) alone, Doxorubicin (6 mg/kg, i.v. SD) alone, Docetaxel (10 mg/kg, q2dx5, i.v.) alone or a combination of TPP-15285 with either Oxaliplatin, Doxorubicin or Docetaxel were evaluated in EMT-6 tumor bearing mice. Therapeutics were formulated in PBS, combination treatment started at the same day with a simultaneous treatment start.

Figure 67:
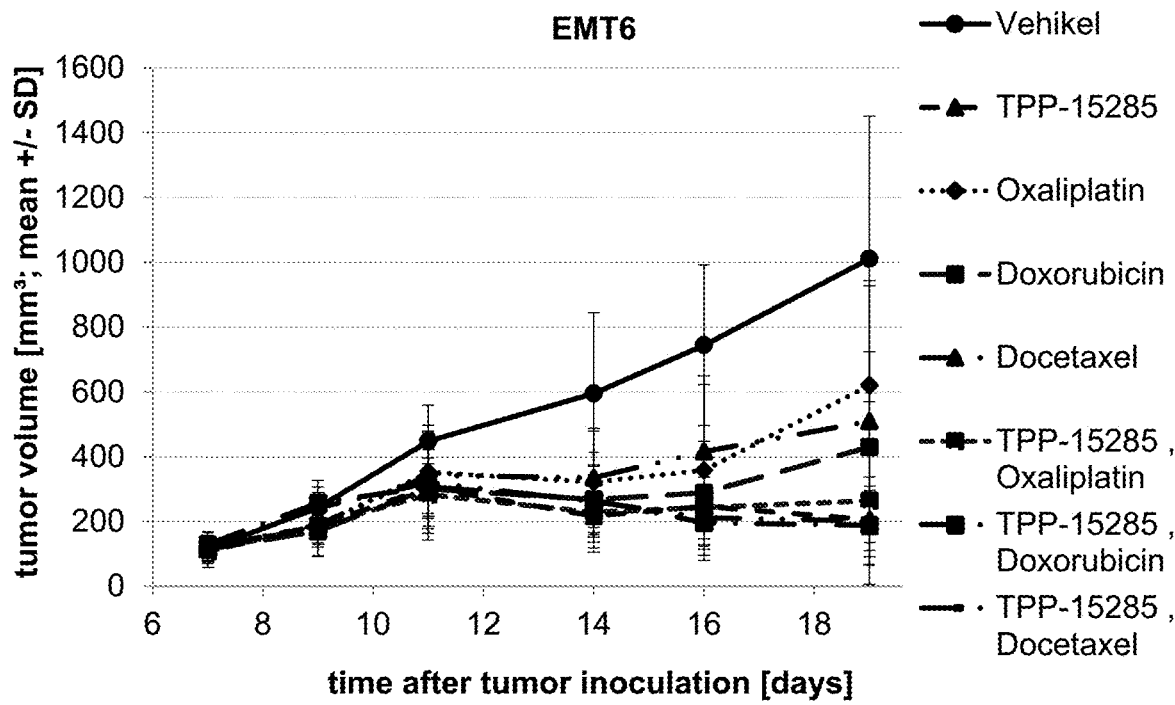
FIG. 67: EMT-6 tumor growth after treatment with anti-CCR8 antibody TPP-15285 (5 mg/kg, q3/4d i.p.), Oxaliplatin (5 mg/kg, q4d i.p.), Doxorubicin (6 mg/kg, i.v. SD), Docetaxel (10 mg/kg, q2dx5, i.v.) or a combination of TPP-15285 with either Oxaliplatin, Doxorubicin or Docetaxel.

While the combination of anti-CCR8 antibody with each chemotherapeutic agent provided benefit over the monotherapy with that chemotherapeutic agent, the combination was not superior over anti-CCR8 monotherapy (FIG. 67).

The inventors are convinced, that sequential administration of the therapeutic agents is beneficial, allowing the anti-CCR8 antibody to effectively deplete Tregs before the chemotherapeutic is applied to deplete fast dividing cells.

Immune cell populations were analyzed at the end of the study, both in tumor and in blood by flow cytometry, cf. Table 12.6.6.1 and Table 12.6.6.2. For combination treatments intra-tumoral CD8/Treg ratio and frequency of activated CD8+CD25+ T cells in the blood was increased compared to each monotherapy and control.

Furthermore, IFN gamma, IL10, IL12p70, IL1beta, IL2 and TNF alpha were analyzed. Increased levels of IFN gamma, IL-1b and IL-2 were observed in mono and combo groups. Increase of TNF alpha was observed in combo groups only (data not shown).

TABLE 12.6.6.1

Intra-tumoral cell populations determined by FACS at the end of the study. *mean for n = 5 samples, cells/100 mg tumor if not specified otherwise.

| | Vehicle (PBS) | TPP15285 | Oxaliplatin | Doxorubicin | Docetaxel | TPP15285 + Oxaliplatin | TPP15285 + Doxorubicin | TPP15285 + Docetaxel |
|---|---|---|---|---|---|---|---|---|
| | | | EMT-6, tumor | | | | | |
| absolute CD8+ cells | 19215.4 | 106043.2 | 42872.6 | 43123.8 | 62549.6 | 107959.2 | 61187.0 | 56554.2 |
| absolute Tregs | 7397.0 | 12816.0 | 7075.2 | 12995.4 | 20688.0 | 6358.0 | 4363.0 | 4693.8 |
| CD8+ cell/Treg ratio | 2.9 | 11.1 | 7.3 | 2.7 | 3.1 | 22.3 | 15.9 | 13.0 |
| % CD8+ cells of CD45+ cells | 1.8 | 14.0 | 5.9 | 5.6 | 5.4 | 13.1 | 14.6 | 9.4 |
| % act. CD8+ cells of CD8+ cells | 37.7 | 13.9 | 26.8 | 22.0 | 17.9 | 17.1 | 21.4 | 23.1 |
| % NK cells of CD45+ cells | 5.3 | 7.9 | 4.2 | 5.0 | 4.8 | 4.8 | 8.6 | 6.5 |

TABLE 12.6.6.2

Blood immune cell populations determined by FACS at the end of the study. *mean for n = 5 samples, cells/100 µl blood EMT-6, blood

| | Vehicle (PBS) | TPP15285 | Oxaliplatin | Doxorubicin | Docetaxel | TPP15285 + Oxaliplatin | TPP15285 + Doxorubicin | TPP15285 + Docetaxel |
|---|---|---|---|---|---|---|---|---|
| absolute CD8+ cells | 13599.6 | 12491.2 | 5208.8 | 5502.0 | 9840.2 | 4094.8 | 4139.8 | 7000.8 |
| absolute Tregs | 1333.2 | 807.8 | 511.8 | 549.2 | 833.8 | 390.8 | 364.8 | 709.2 |
| Absolute CD45+ cells | 188940 | 166472 | 120713 | 104991 | 105002 | 47850 | 65061 | 121155 |
| CD8+ cell/Treg ratio | 12.4 | 15.6 | 13.8 | 12.6 | 12.2 | 10.0 | 13.2 | 10.2 |
| % CD8+ cells of CD45+ cells | 7.1 | 6.9 | 5.4 | 5.6 | 9.5 | 8.2 | 6.7 | 6.3 |
| % act. CD8 of CD8+ cells | 1.6 | 3.1 | 2.0 | 4.2 | 4.2 | 6.7 | 10.7 | 10.3 |

Figure 69:
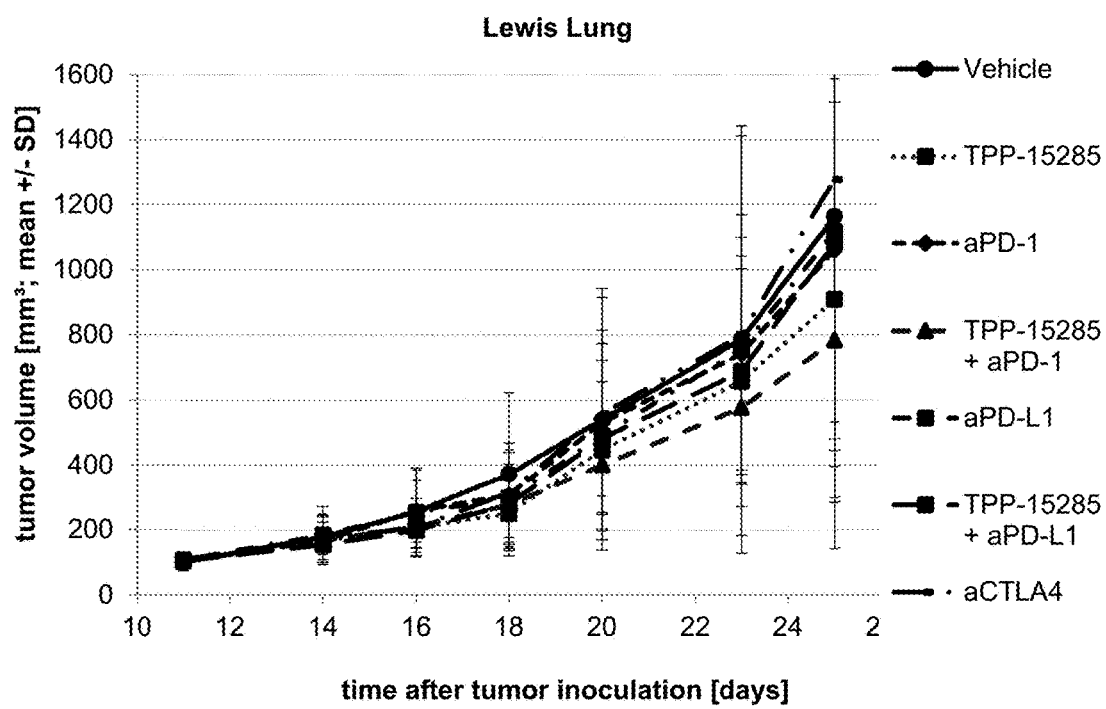
FIG. 69: Lewis lung tumor growth after treatment with anti-CCR8 antibody TPP-15285 (10 mg/kg) alone, anti-PD-1 antibody (aPD-1, CDRs: atezolizumab, 10 mg/kg) alone, anti-PD-L1 antibody (10 mg/kg) alone, anti-CTLA4 antibody alone, TPP-15285 (10 mg/kg) and anti-murine PD-1 antibody (10 mg/kg) in combination, or TPP-15285 (10 mg/kg) and anti-PD-L1 antibody (10 mg/kg) in combination.

Example 12.6.7: Sequential Combination Treatment with Anti-PD-(L)1 Antibody and Anti-CCR8 Antibody in Lewis Lung Carcinoma Bearing Mice The therapeutic efficacies of anti-CCR8 antibody TPP-15285 (10 mg/kg) alone, anti-PD-1 antibody (aPD-1, CDRs: atezolizumab, 10 mg/kg) alone, anti-PD-L1 antibody (10 mg/kg) alone, anti-CTLA4 antibody alone, TPP-15285 (10 mg/kg) and anti-PD-1 antibody (10 mg/kg) in combination, or TPP-15285 (10 mg/kg) and anti-PD-L1 antibody (10 mg/kg) in combination were evaluated in Lewis lung tumor bearing mice (FIG. 69). Antibodies were formulated in PBS. For the anti-CCR8 antibody, doses were administered at day 11, 14, 18 and 22 after tumor inoculation. For combination treatment, administration of anti-PD-(L)1 antibody started 24 hours after the $2^{nd}$ anti-CCR8-antibody dose. At this time point, FACS analysis showed an intra-tumoral Treg depletion for the TPP-15285 mono group of 60% relative to the isotype control (data not shown). Lewis lung was used as a syngeneic model with a suppressive tumor microenvironment and is known to be not responsive for anti PD-(L)1 treatment and anti-CTLA4 treatment. No monotherapeutic efficacy of TPP-15285 was observed despite effective Treg depletion measured 24 hours after $2^{nd}$ treatment. However, the combination treatment with anti-murine PD-1 antibody after anti-CCR8 antibody showed improved efficacy and this was also associated with increased CD8/Treg ratio at study end (Table 12.6.7.1).

Figure 70:
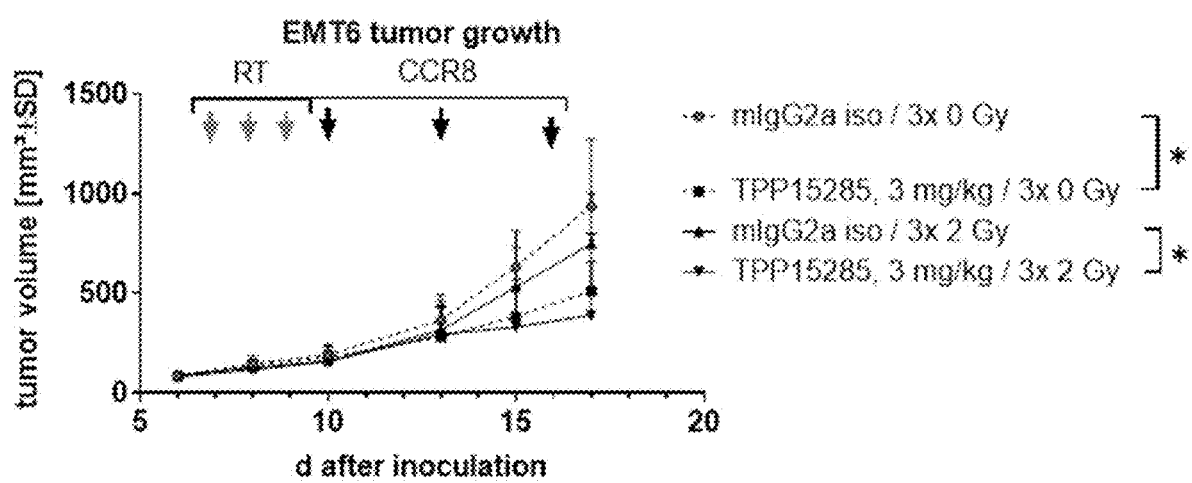
FIG. 70: EMT-6 tumor growth after treatment with anti-CCR8 antibody TPP-15285 (3 mg/kg) or radiotherapy (RT, 3×2 Gy) alone or in combination. Significance was determined by 1-Way ANOVA plus Sidak's post-test after log transform.
Figure 71:
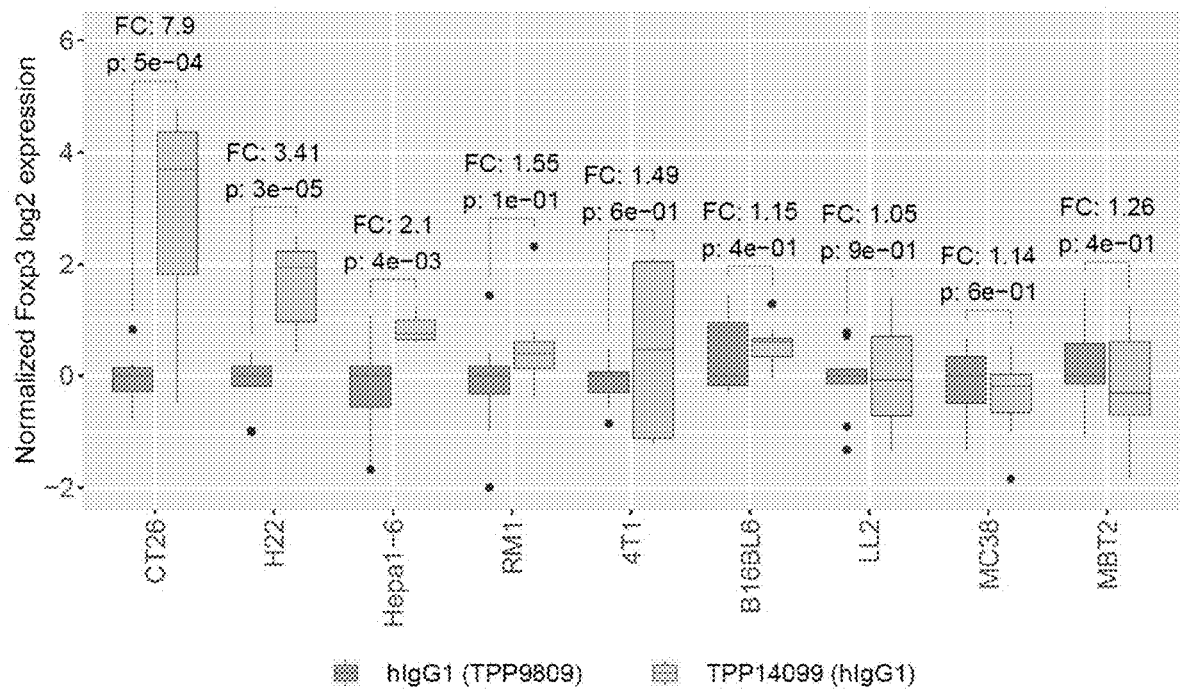
FIG. 71: mRNA expression levels of different immune cell markers in different syngeneic tumor models treated with either isotype control (TPP-9809) or anti-CCR8 antibody (TPP-14099). Median expression in the isotype treated control groups is set to zero. Gene expression is measured in transcripts per million (TPM) as estimated by the RSEM algorithm. Treg marker Foxp3. Significantly higher Foxp3 levels are observed in the CT26, H22, Hepa1-6, and RM1 models treated with TPP-14099, indicating increased Treg infiltration, after administration of at least three doses of TPP-14099.
Figure 72:
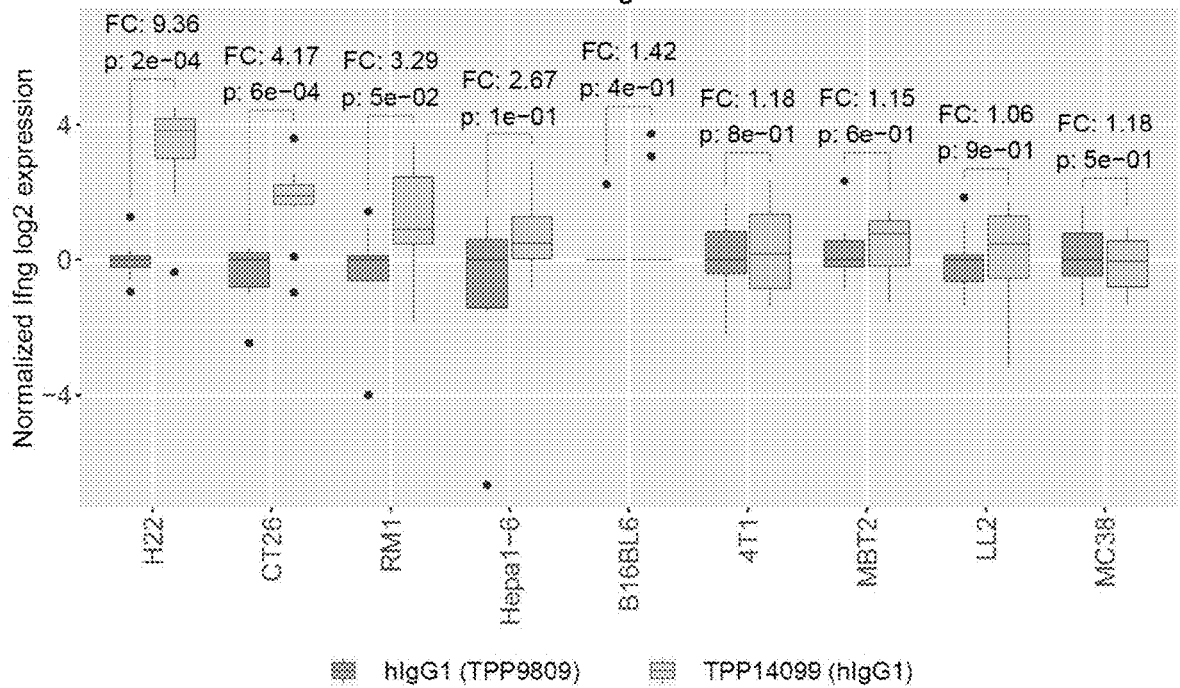
FIG. 72: Inflammation marker 1 fng. Significantly higher 1 fng levels are observed in the H22, CT26, and RM1 models treated with TPP-14099 pointing towards a strong pro inflammatory activity induced by TPP-14099.
Figure 73:
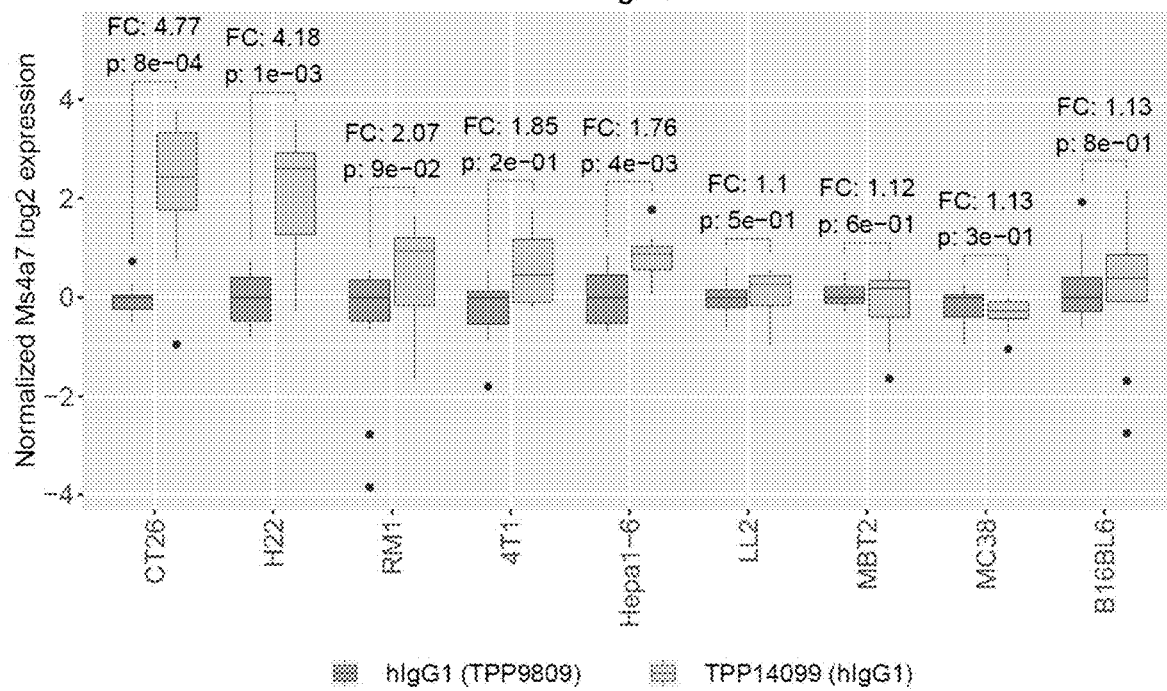
FIG. 73: Macrophage marker Ms4a7. Significantly higher Ms4a7 levels are observed in the CT26, H22, and Hepa1-6 models treated with TPP-14099, indicating increased infiltration of macrophages caused by TPP-14099.
Figure 74:
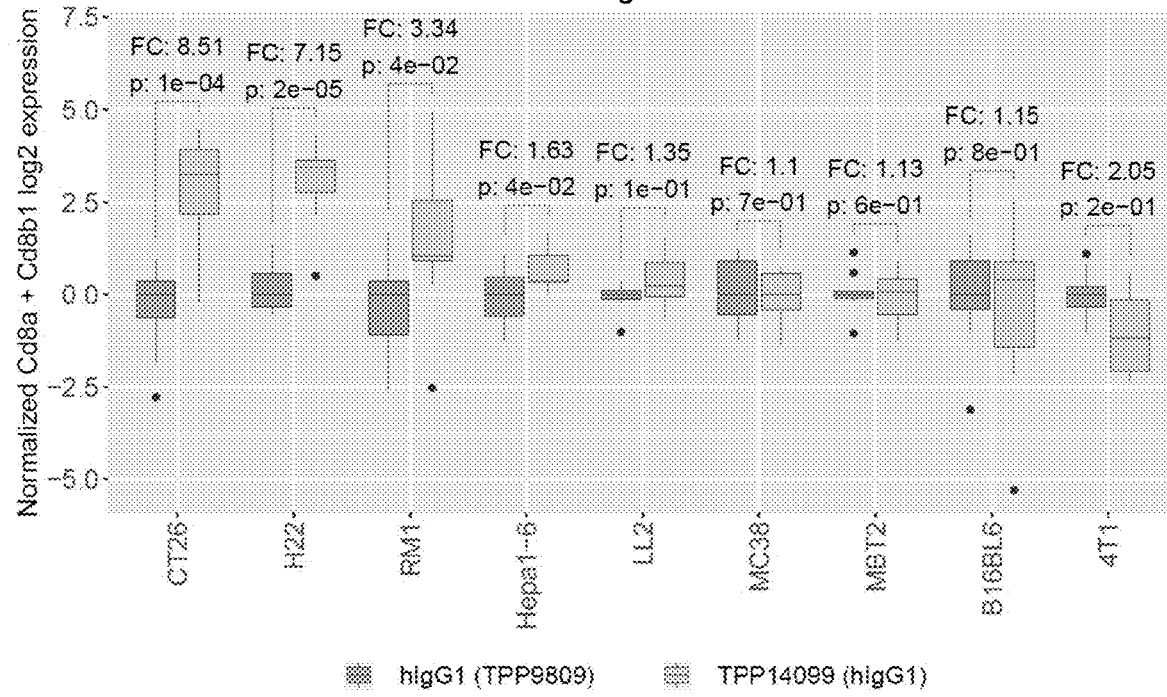
FIG. 74: Cytotoxic T cell markers Cd8a and Cd8b1. Significantly higher cytotoxic T cell levels are observed in the CT26, H22, RM1, and Hepa1-6 models treated with TPP-14099 indicating the induction of cytotoxic T cell infiltration and/or proliferation by TPP-14099.
Figure 75:
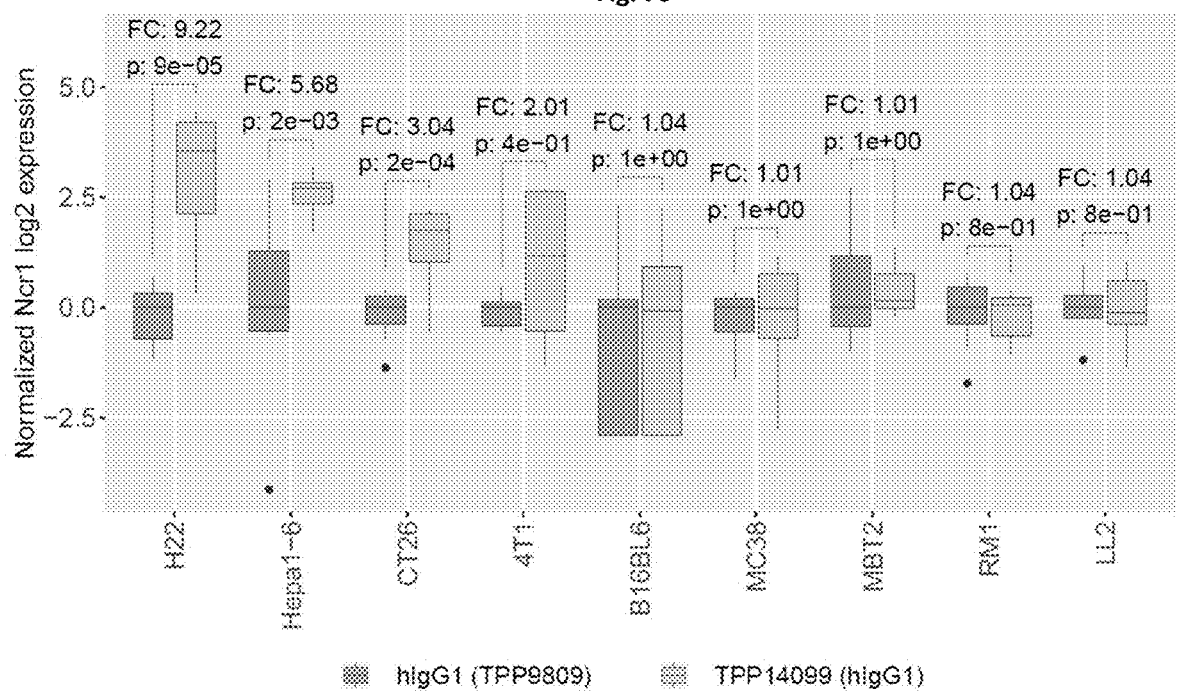
FIG. 75: Natural killer (NK) cell marker Ncr1. Significantly higher NK cell levels are observed in the CT26, H22, and Hepa1-6 models treated with TPP-14099.
Figure 76:
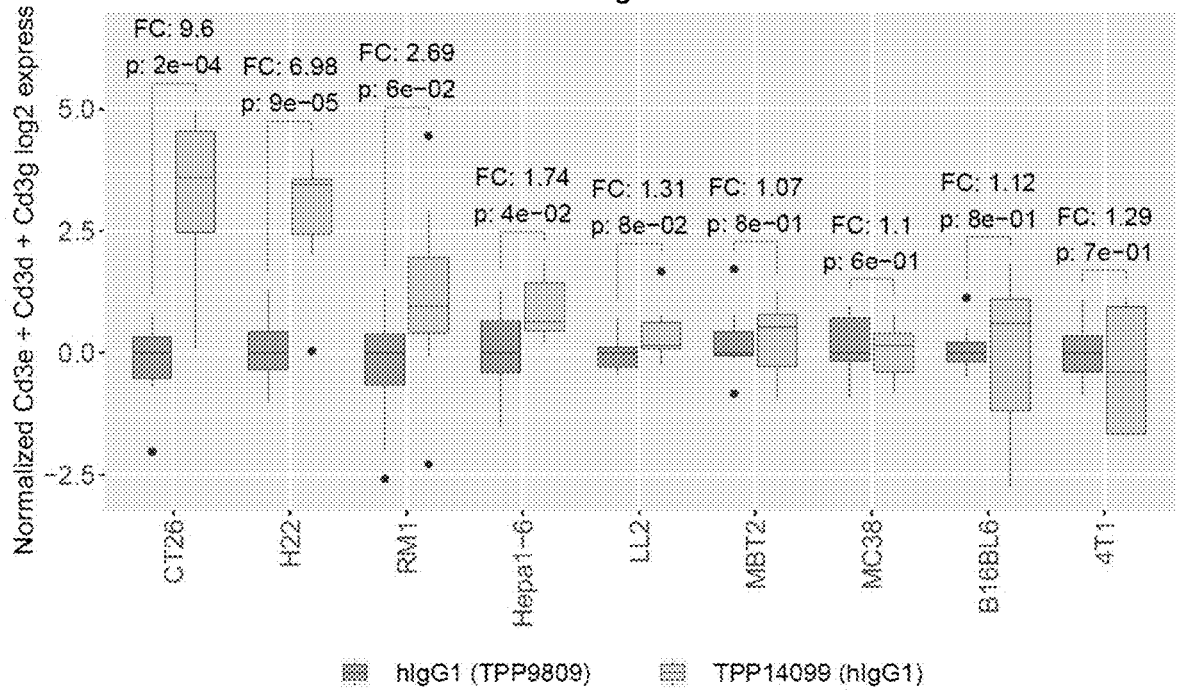
FIG. 76: Pan T cell markers Cd3e/d/g. Significantly higher T cell levels are observed in the CT26, H22, and Hepa1-6 models treated with TPP-14099.
Figure 77:
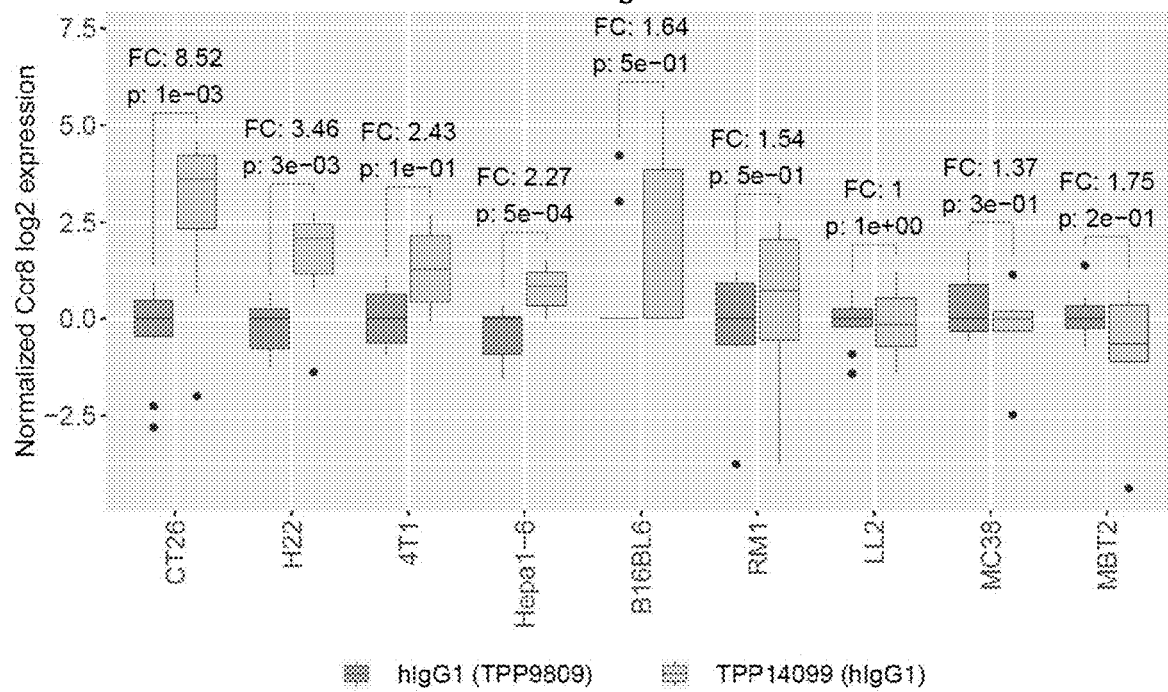
FIG. 77: Activated Treg marker and antibody target Ccr8. Significantly higher Ccr8 levels are observed in the CT26, H22, and Hepa1-6 models treated with TPP-14099.
Figure 78:
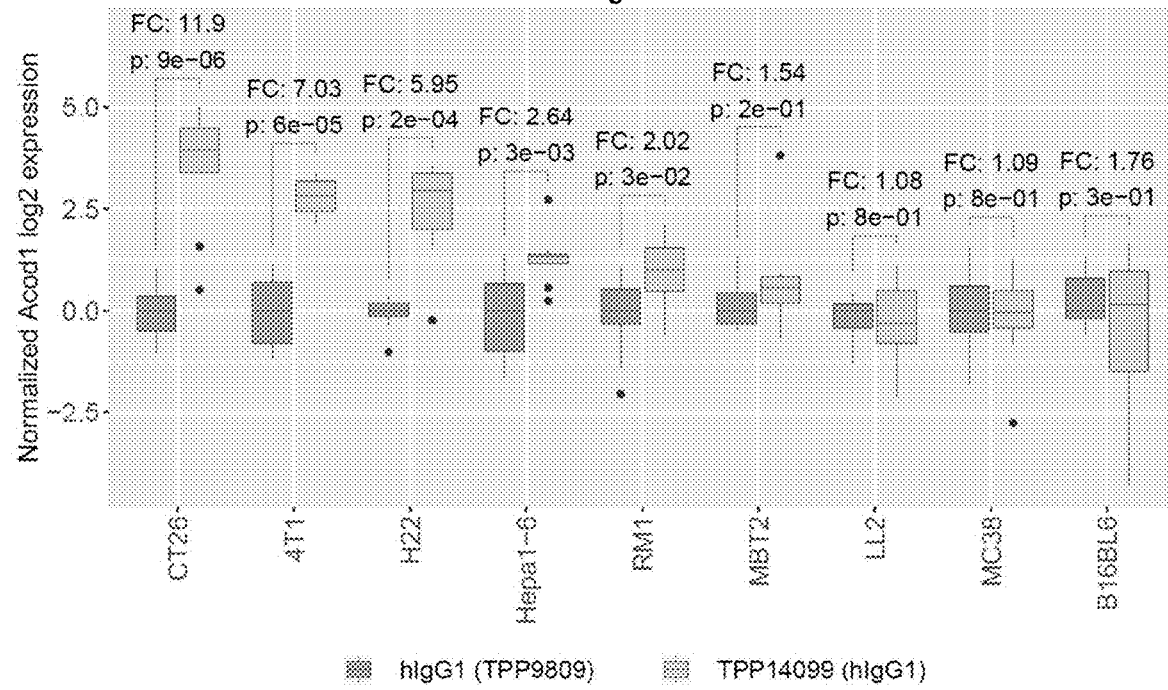
FIG. 78: Highly specific pro-inflammatory M1 macrophage marker Acod1 (a) and highly specific anti-inflammatory M2 macrophage marker Mrc1 (b). Markedly higher M1 macrophage levels are observed in the CT26, 4T1, H22, Hepa1-6, and RM1 models treated with TPP-14099, while no markedly higher M2 macrophage levels are observed across all models treated with TPP-14099.
Figure 78:
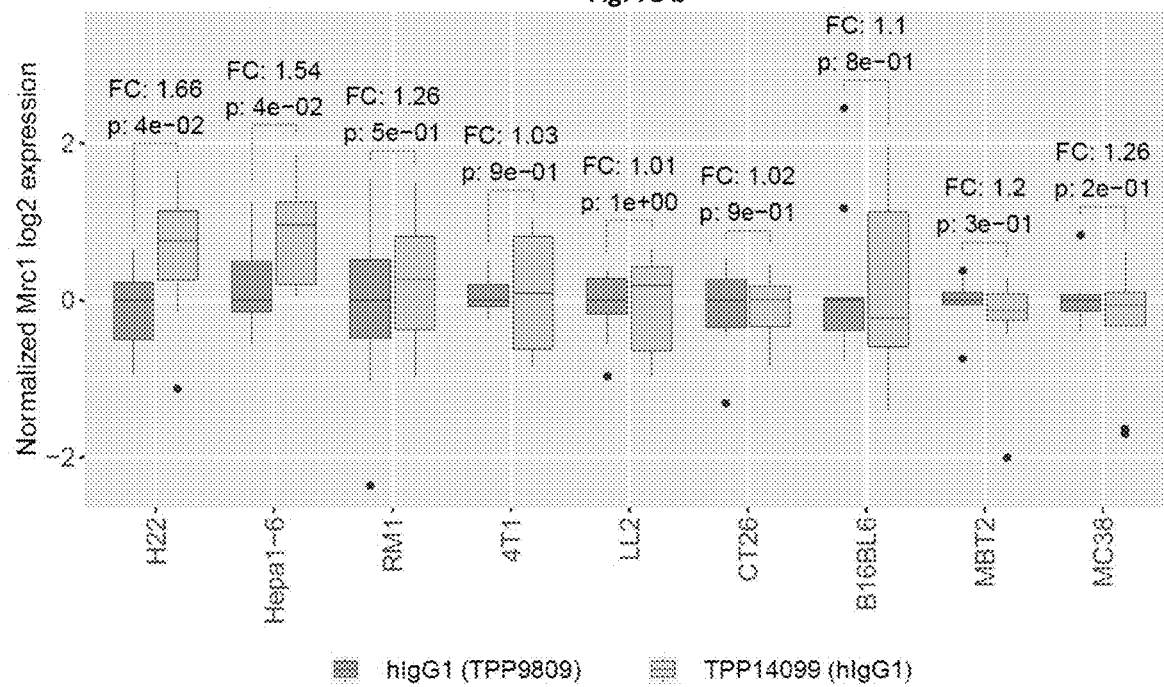
Figure 79:
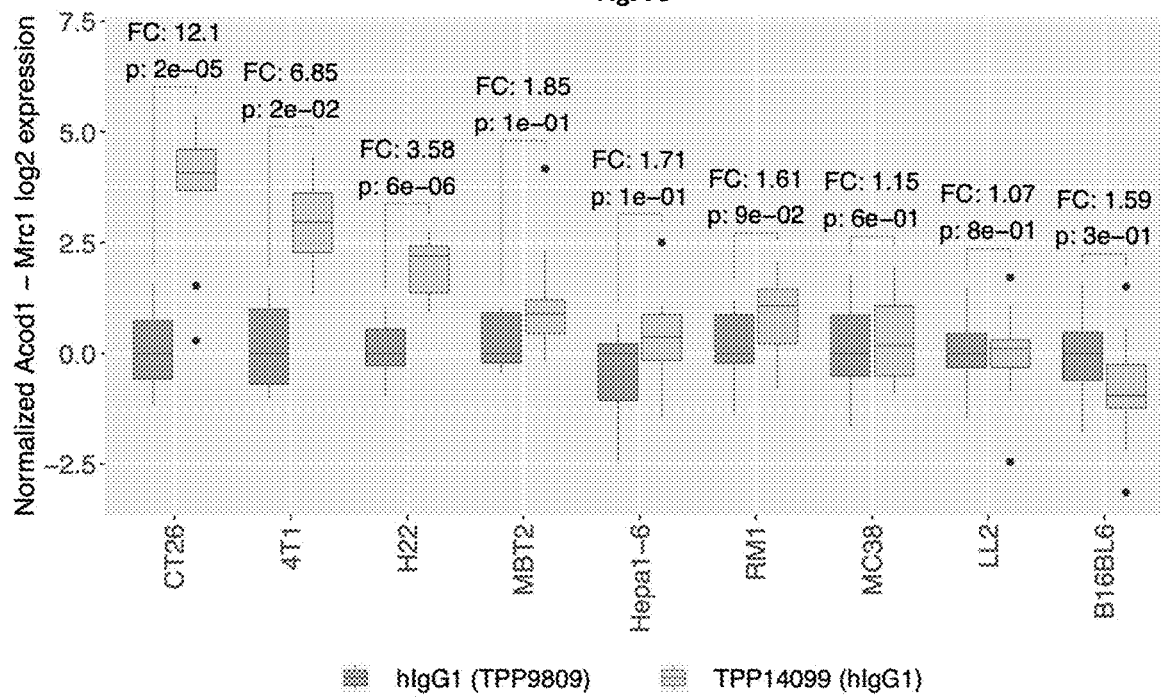
FIG. 79: Ratio of highly specific pro-inflammatory M1 macrophage marker Acod1 and highly specific anti-inflammatory M2 macrophage marker Mrc1. Taken together, multiple doses of anti-CCR8 antibody TPP-14099 increased the M1/M2 macrophage ratio in these tumor models.
Figure 80:
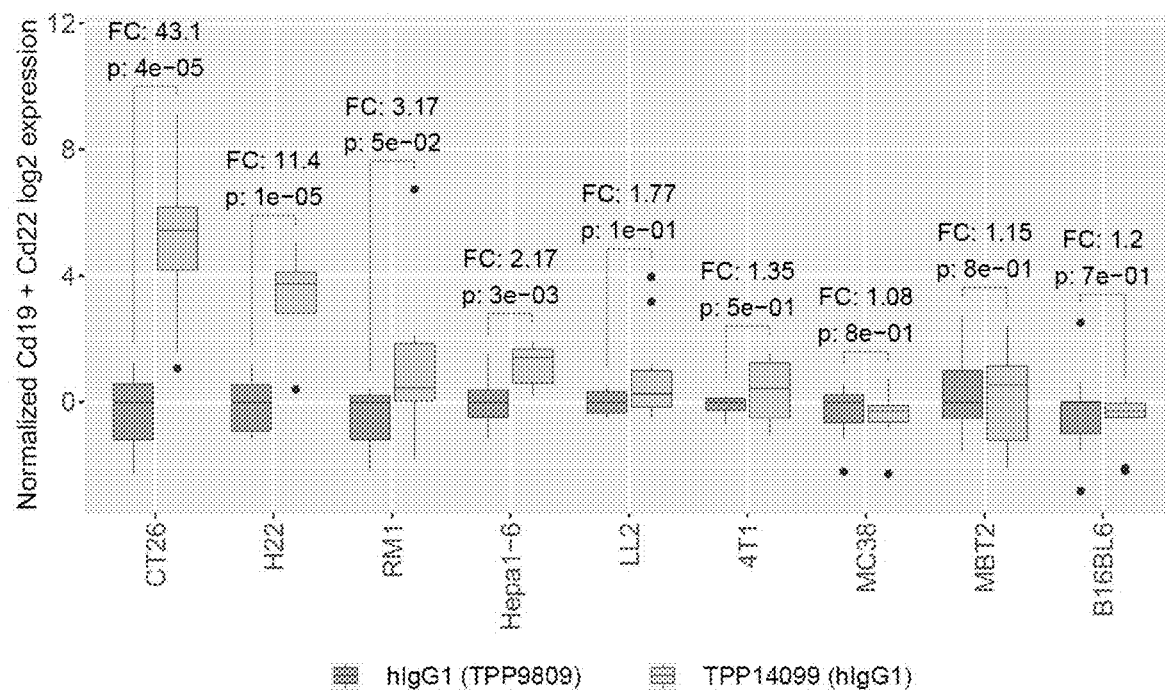
FIG. 80: B cell markers Cd19 and Cd22. Markedly higher B cell levels are observed in the CT26, H22, RM1, and Hepa1-6 models treated with TPP-14099. Anti-CCR8 antibody seems to recruit B cells to the tumor. Without being bound by theory, recruitment of B cells may affect the anti-tumor response elicited by TPP-14099.
Figure 81:
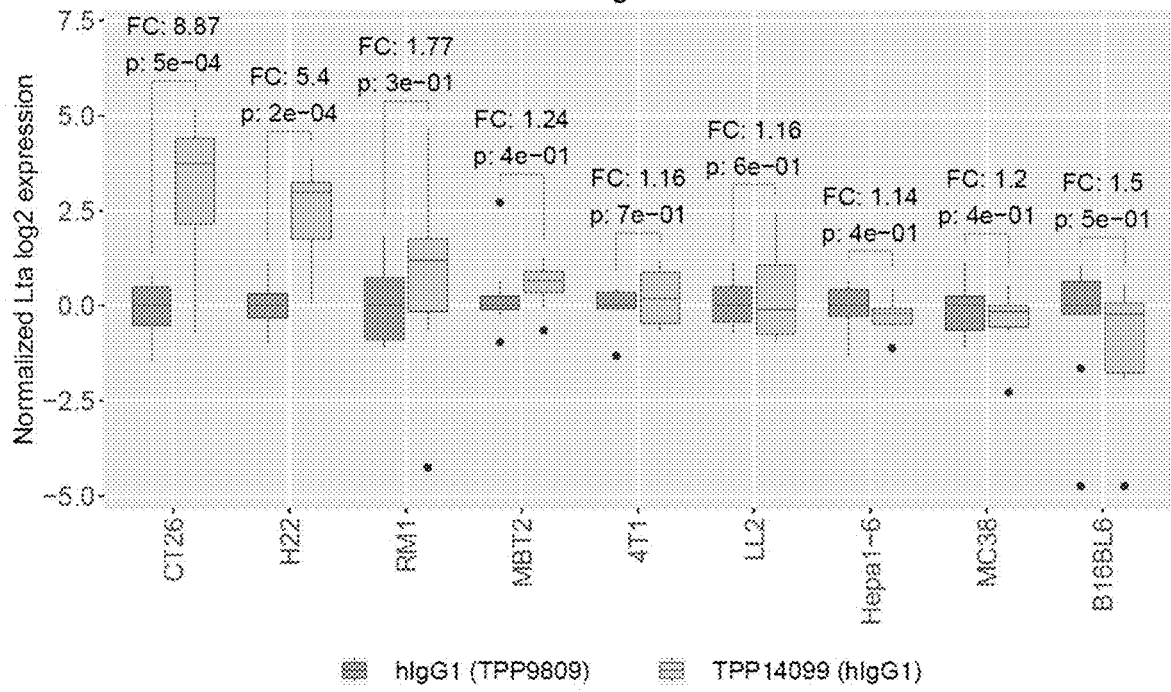
FIG. 81: Expression levels for LTta/b as well as Cxcr5 and its ligand Cxcl13. These markers are crucial for the development of lymph nodes as well as tertiary lymphoid structures (cf. Cyster, Jason G. "Blown away: the unexpected role of lymphotoxin in lymphoid organ development." The Journal of Immunology 192.5 (2014): 2007-2009, and Cupedo, Tom, et al. "Induction of secondary and tertiary lymphoid structures in the skin." Immunity 21.5 (2004): 655-667.) which are key drivers of an anti-tumor effect in humans (cf. Dieu-Nosjean, Marie-Caroline, et al. "Tertiary lymphoid structures, drivers of the anti-tumor responses in human cancers." Immunological reviews 271.1 (2016): 260-275.). All three publications are incorporated herein by reference in their entirety.
Figure 81:
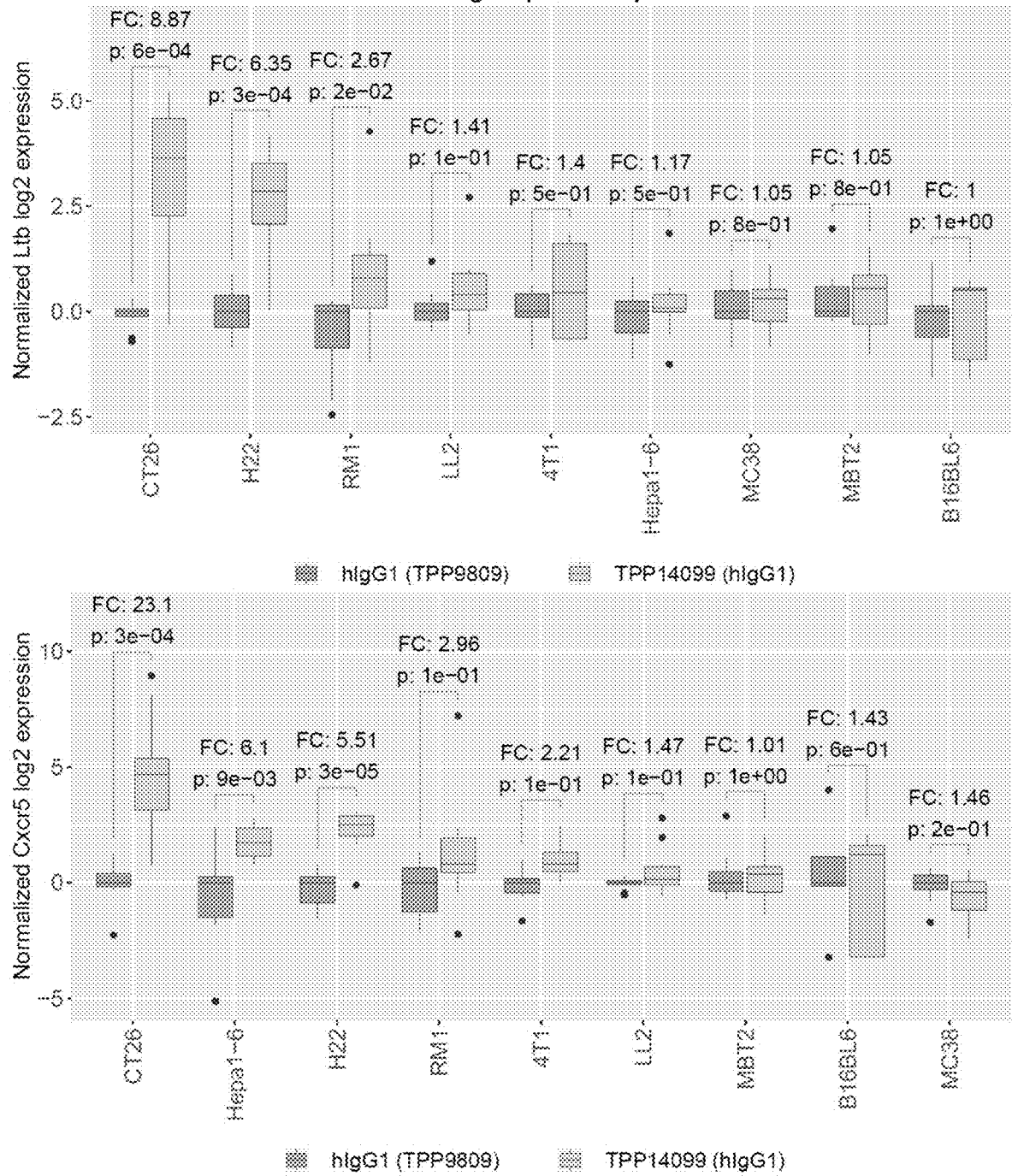
Figure 81:
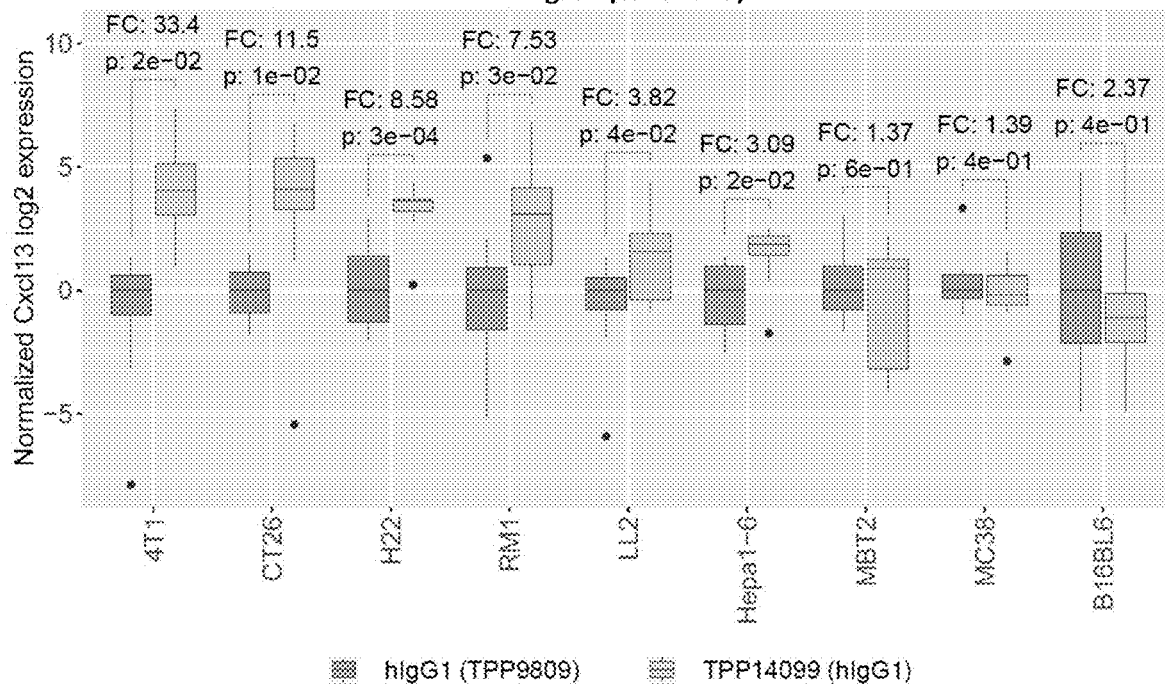
Figure 82:
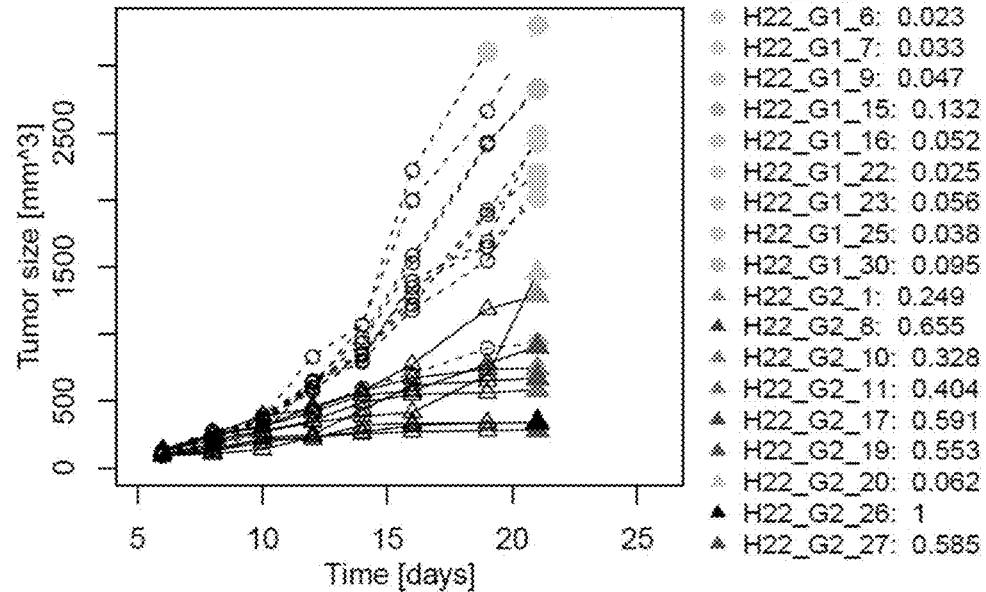
FIG. 82: Spider plots of tumor growth (measured in $mm^3$) over time in the TPP-14099 treatment group (shown as triangles) and isotype control treated group (shown as circles) for different tumor models. Levels of T cell infiltration at the end of the study, as judged by Cd8a mRNA levels in corresponding bulk tumor samples, are indicated by grey shades (black and light grey correspond to highest and lowest Cd8a levels, respectively). In H22 and CT26, tumor size showed an excellent anti-correlation with Cd8a levels.
Figure 82:
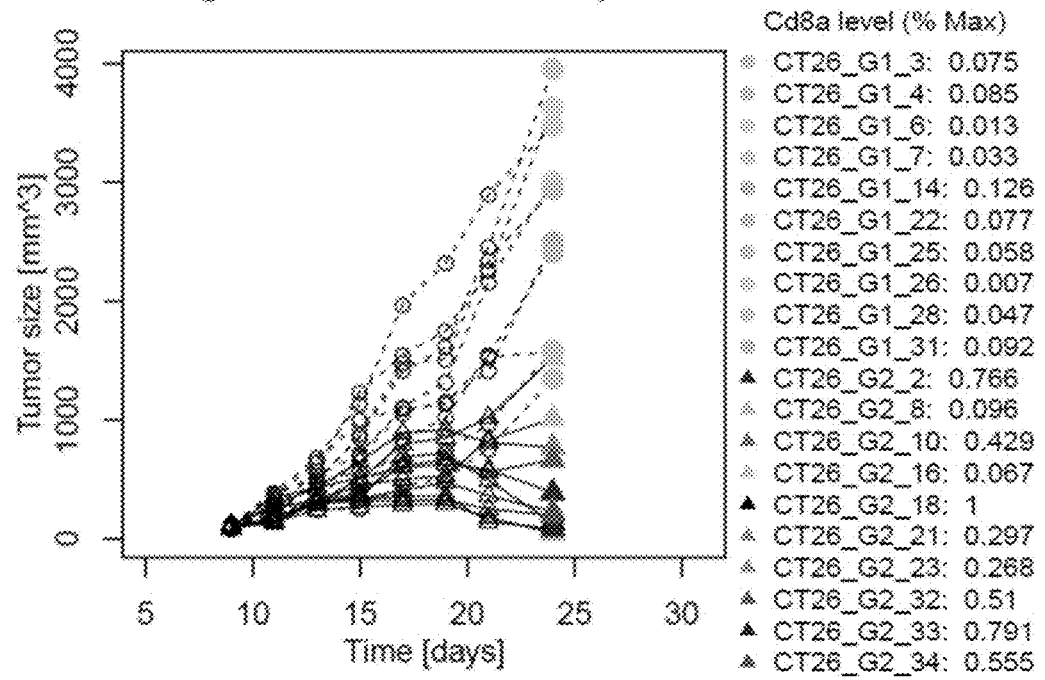
Figure 83:
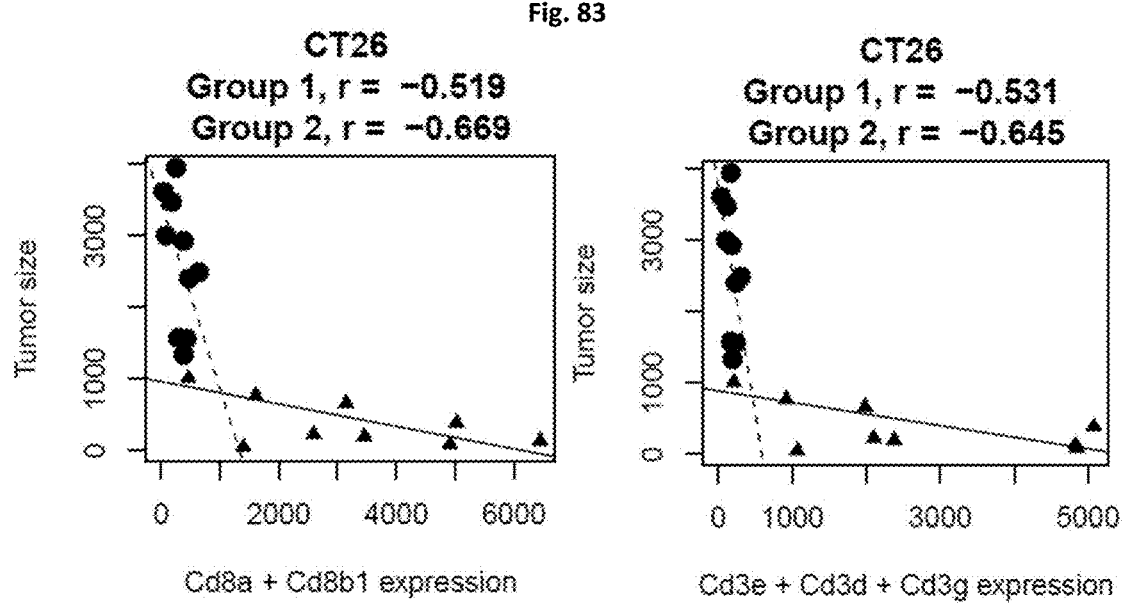
FIG. 83: Correlation between infiltration of the tumor by different immune cell populations as judged by mRNA levels of different immune cell markers and tumor size. TPP-14099 treated tumors are shown as triangles and isotype treated tumors are shown as circles. Tumor size is measured in $mm^3$. Strong negative correlation between cytotoxic T cell infiltration (as judged by Cd8a+Cd8b1 mRNA levels) and CT26 tumor sizes. TPP-14099 treated tumors are smaller in size and show higher Cd8a+Cd8b1 T cell infiltration levels than controls, indicating that increased T cell infiltration upon TPP-14099 treatment causes reduced tumor growth. Strong negative correlation between T cell infiltration (as measured by Cd3 mRNA levels) and CT26 tumor sizes in the TPP-14099 treated tumors. TPP-14099 treated tumors are smaller in size and show higher T cell infiltration levels, i.e. the higher the level of Cd3 mRNA the smaller the tumors. Negative correlation between NK cell infiltration (as judged by NK marker Ncr1 expression) and CT26 tumor sizes. TPP-14099 treated tumors are smaller in size and show higher NK cell infiltration. Tumor size is strongly negatively correlated with NK infiltration, the higher the level of NK, the smaller the tumors. Correlation between postulated induction of tertiary lymphoid structures as judged by Lta/Ltb/Cxcr5 and Cxcl13 mRNA levels and CT26 tumor sizes in the TPP-14099 treated tumors. For each of the four markers, the level is strongly increased after TPP-14099 treatment, and tumor size is strongly negatively correlated with the expression level, indicating that increased formation of tertiary lymphoid structures upon TPP-14099 treatment causes reduced tumor growth.
Figure 83:
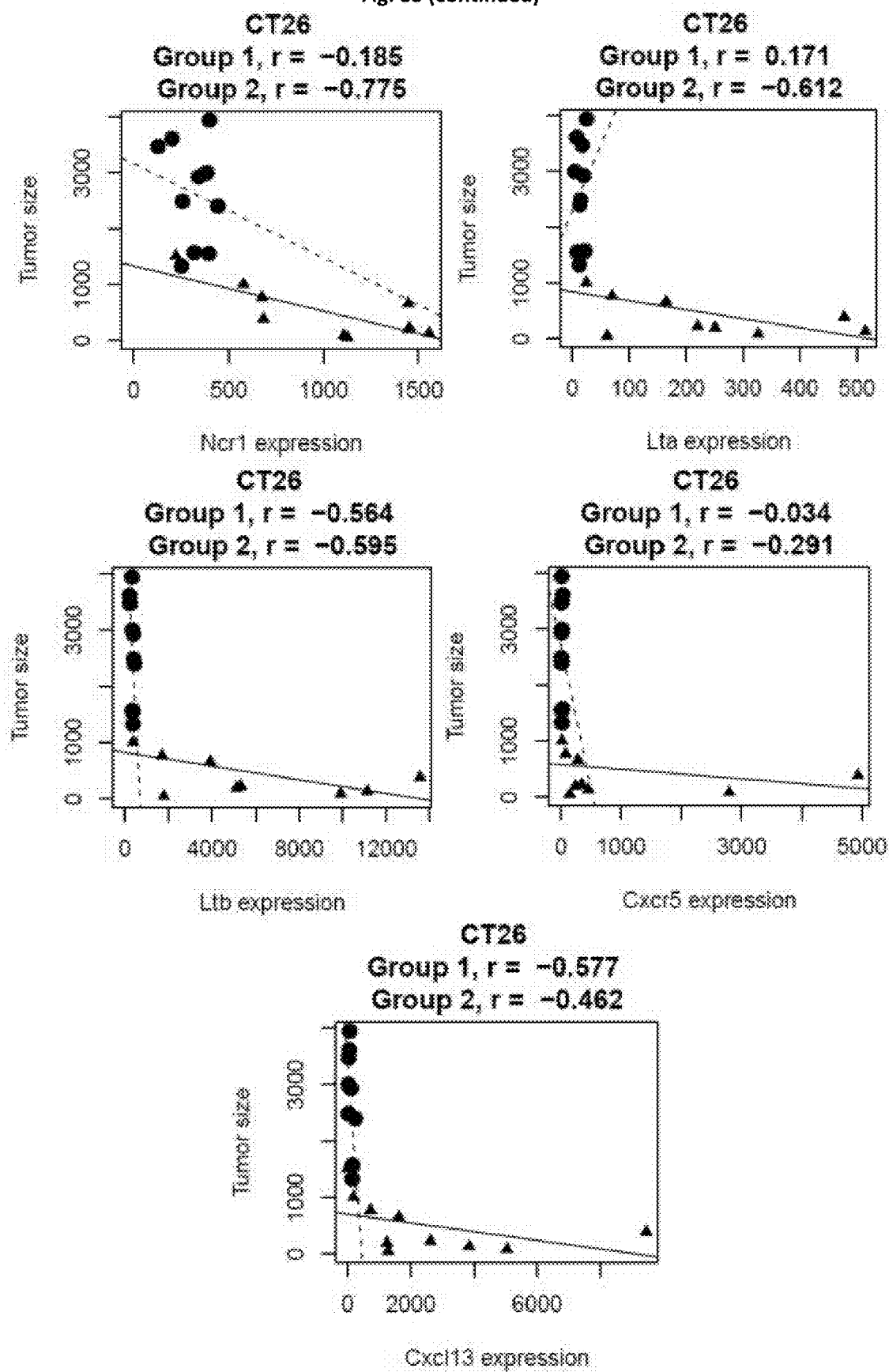
Figure 84:
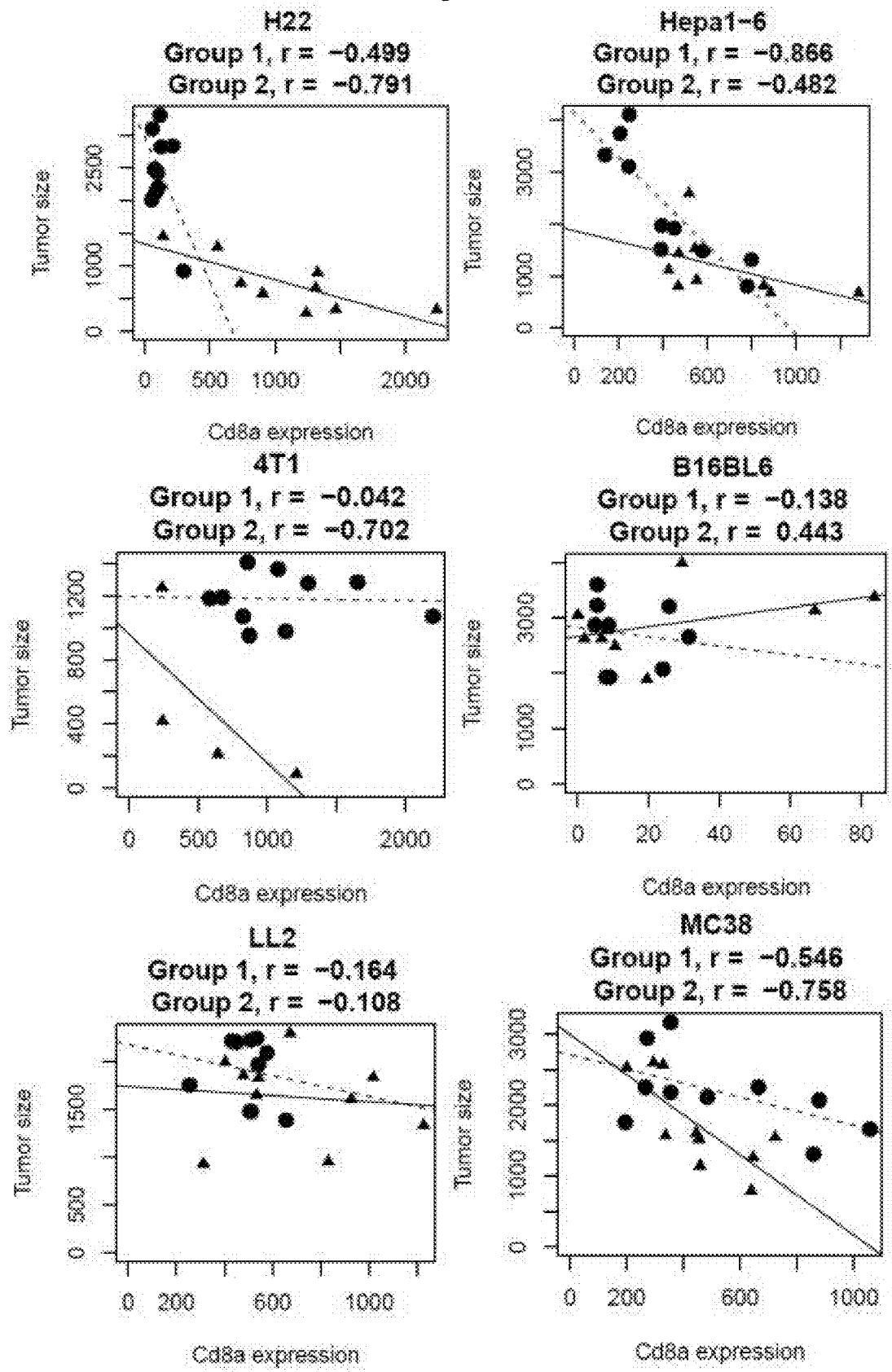
FIG. 84: Correlation between Cd8a infiltration levels, as judged by Cd8a mRNA expression, and tumor sizes in the TPP-14099 treated tumors (shown as triangles) and in the isotype treated control group (shown as circles) for different tumor models. TPP-14099 treated tumors are smaller in size and show higher Cd8a infiltration levels. Tumor size is strongly negatively correlated with Cd8a infiltration, the higher the level of Cd8a, the smaller the tumors.
Figure 84:
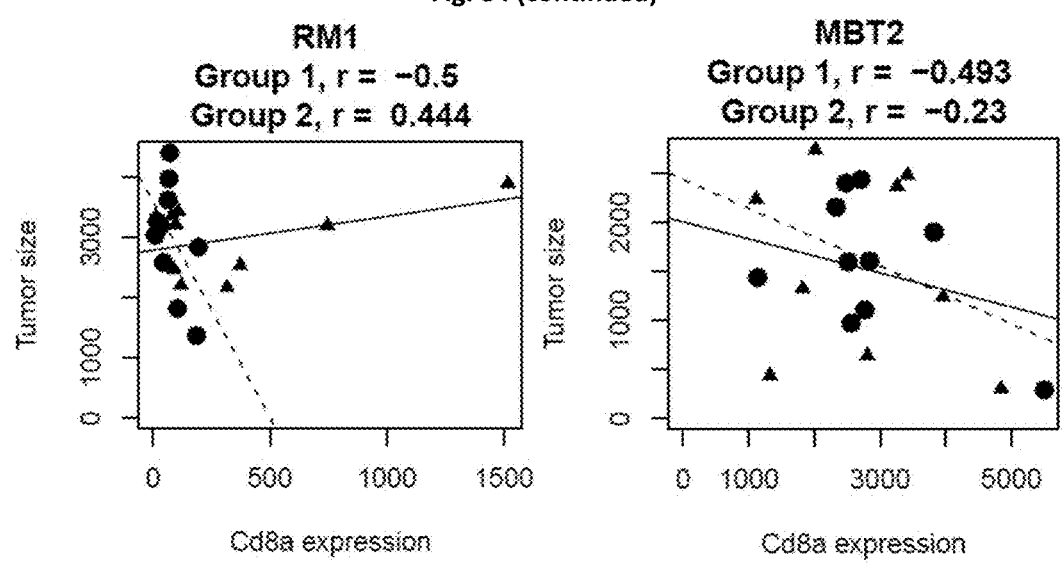

Example 12.6.8: Combination Treatment Comprising Anti-CCR8 Antibody and Radiotherapy in EMT-6 Tumor Bearing Mice The therapeutic efficacies of anti-CCR8 antibody TPP-15285 (3 mg/kg) or radiotherapy (RT, 3×2 Gy) were evaluated alone or in combination in EMT-6 tumor bearing mice (FIG. 70). Combination treatment was started with 3×2 Gy fractionated irradiation, followed by 3 mg/kg biw×2. Radiation therapy alone only mildly delayed tumor growth. Combination of anti-CCR8 antibody and radiotherapy showed only minor improvement in efficacy but Treg depletion at study end was more pronounced than for each monotherapy (data not shown).

Example 12.6.9: Combination Treatment Comprising Anti-CCR8 Antibody and Administration of PD-1 Antibody, PD-L1 Antibody, or Paclitaxel in MBT2 Tumor Bearing Mice The therapeutic efficacies of inventive anti-CCR8 antibody, anti-PD-1 antibody, anti-PD-L1 antibody, or Paclitaxel were tested alone or in combination in MBT2 syngeneic tumor bearing mice as shown in Table 12.6.9.1. Each group comprised 10 tumor-bearing mice and treatment started at day 10 after inoculation, when tumors had reached a size of about 100 mm³. Among the single treatment groups, anti-CCR8 showed the strongest and a significant anti-tumor effect. The anti-tumor effect of anti-PD-1 antibody, anti-PD-L1 antibody, or Paclitaxel was significantly increased by combining these treatments with anti-CCR8 therapy. Antibodies were formulated in PBS. T/C ratios were analyzed after three weeks of bi-weekly treatment.

TABLE 12.6.7.1

Intra-tumoral cell populations determined by FACS at the study end. *mean for n = 5 samples.

| Intra-tumoralcells | Vehicle (PBS) | TPP15285 | Anti-PD-1 ab | TPP15285 + +Anti-PD-1 ab | Anti-PD-L1 ab | TPP15285 + Anti-PD-L1 ab |
|---|---|---|---|---|---|---|
| absolute CD8+ | 4682.4 | 7617.0 | 4593.8 | 6162.2 | 5684.4 | 7769.4 |
| absolute Tregs | 1202.6 | 1452.0 | 1207.0 | 805.8 | 1480.6 | 1355.0 |
| CD8/ Treg ratio | 4.0 | 7.9 | 6.0 | 7.3 | 4.7 | 5.1 |
| % CD8 | 0.7 | 0.8 | 0.6 | 1.5 | 0.8 | 0.9 |
| % activated CD8 | 19.8 | 14.9 | 11.9 | 12.2 | 24.5 | 18.6 |

TABLE 12.6.9.1

Treatment groups and T/C ratio relative to isotype control at day 24.

| Group | Treatment | Dose | Route | Dose scheme | T/C |
|---|---|---|---|---|---|
| 01 | Isotype control | 10 mg/kg | i.p. | BIW | 1 |
| 02 | Anti-CCR8 antibody TPP15285 | 10 mg/kg | i.p. | BIW | 0.50 |
| 03 | anti-PDL1 antibody | 10 mg/kg | i.p. | BIW | 0.89 |
| 04 | anti-PD1 antibody | 10 mg/kg | i.p. | BIW | 0.66 |
| 05 | Paclitaxel | 10 mg/kg | i.v. | Q4D | 0.83 |
| 06 | Combination: TPP15285 + anti-PDL1 ab | 10 mg/kg | i.p. + i.p. | BIW + BIW | 0.41 |
| 07 | Combination of TPP15285 + anti-PD1 ab | 10 mg/kg | i.p. + i.p. | BIW + BIW | 0.15 |
| 08 | Combination of TPP15285 + Paclitaxel | 10 mg/kg | i.p. + i.v. | BIW + Q4D | 0.39 |

TABLE 12.6.9.2

| Treatment | Mean CD8 expression | Standard deviation | Fold change to Isotype | T-test p-value |
|---|---|---|---|---|
| Isotype [TPP10748] | 7.493 | 1.378 | 1.000 | 1.0E+00 |
| anti-CCR8 [TPP15285, 10 mg/kg, BIW] | 9.308 | 1.282 | 3.518 | 2.5E−04 |
| anti-PD-L1 [10 mg/kg, BIW] | 7.929 | 1.448 | 1.353 | 3.6E−01 |
| anti-PD1 [10 mg/kg, BIW] | 8.156 | 0.915 | 1.583 | 1.1E−01 |
| Paclitaxel [10 mg/kg, Q4D] | 8.260 | 1.197 | 1.702 | 9.2E−02 |
| anti-CCR8 + PDL1 | 9.805 | 0.984 | 4.966 | 2.3E−06 |
| anti-CCR8 + PD1 | 10.524 | 1.078 | 8.171 | 9.4E−08 |
| anti-CCR8 + Paclitaxel | 9.018 | 1.088 | 2.876 | 6.9E−04 |

CD8 mRNA levels are increased after anti-CCR8 combination treatments. CD8 mRNA levels were obtained via RNA-seq performed on MBT2 tumors obtained 24 h after the end of the treatment cycle. Average CD8 expression levels were computed for 10 tumors from each treatment group. Anti-CCR8 had treatment alone significantly increased CD8 levels compared to isotype while PD1, PDL1, and paclitaxel no significant effect. CD8 levels were further increased by combining anti-CCR8 treatment with the other three treatments. The most significant and strongest increase of over 8-fold was obtained by the combination of anti-CCR8 with anti-PD1 treatment.

TABLE 12.6.9.3

| Group | Treatment | Mean tumor size [mm3] | SD tumor size [mm3] | T/C ratio | T-test p-value |
|---|---|---|---|---|---|
| 1 | Isotype [TPP10748] | 3108.8 | 697.9 | 1 | 1.00E+00 |
| 2 | anti-CCR8 [TPP15285 10 mg/kg, BIW] | 1539.9 | 1431.4 | 0.50 | 1.38E−02 |
| 3 | anti-PD-L1 [10 mg/kg, BIW] | 2758.1 | 972.3 | 0.89 | 4.33E−01 |
| 4 | anti-PD1 [10 mg/kg, BIW] | 2051.7 | 1491.6 | 0.66 | 1.03E−01 |
| 5 | Paclitaxel [10 mg/kg, Q4D] | 2566.2 | 963.7 | 0.83 | 2.53E−01 |
| 6 | anti-CCR8 + PDL1 | 1274.9 | 1159.0 | 0.41 | 1.68E−03 |
| 7 | anti-CCR8 + PD1 | 473.1 | 571.7 | 0.15 | 4.12E−06 |
| 8 | anti-CCR8 + Paclitaxel | 1197.1 | 826.4 | 0.39 | 3.14E−04 |

Tumor sizes at day 24 are significantly reduced by anti-CCR8 treatment and further reduced by combining anti-CCR8 with either PD1 antibody (CrownVivoPremium, Catalog No RMP1-14), PDL1 antibody (CrownVivoPremium, Catalog No CVP034), or Paclitaxel. Largest and most significant reduction in tumor size compared to isotype control is achieved by the combination of anti-CCR8 with anti-PD1 antibody.

Example 12.7.1: Correlation Between Anti PD-L1 Antibody Response and Anti-CCR8 Antibody Response In order to benchmark the efficacy of anti-CCR8 antibody treatment against treatment with anti-PD-L1 antibody, the outcomes for the different syngeneic tumor models were assembled, see Table 12.7.1.1. Surprisingly, a good response to anti-PD-L1 antibody treatment—as measured e.g. by T/C volume—was also predictive for a good response to anti-CCR8 antibody treatment. PD-L1 expression is a known predictor to select responders to anti-PD-L1 treatment. From these observations, the inventors hypothesized that PD-L1 expression might likewise be suitable to stratify subjects in order to identify those which would most likely profit from anti-CCR8 antibody treatment. This hypothesis could be retroactively validated by correlating the PD-L1 expression levels with tumor volume.

TABLE 12.7.1.1

Comparison between responses to anti PD-L1 antibody vs. anti-CCR8 antibody for different syngeneic models.

|  | Tumor Model | General immune cell infiltration | T/C$_{vol}$ (end of experiment) aCCR8 | T/C$_{vol}$ (end of experiment) aPDL1 | % Treg depletion [1] aCCR8 | Tumoral CD8+ change* aCCR8 | ORR [#] (% CR) aCCR8 |
|---|---|---|---|---|---|---|---|
| Responding models | CT26 | high | 0.18 | 0.68 | 82.3 | 2.84[1] | 72 (30) |
|  | EMT-6 | medium | 0.28 | 0.68 | 61.6 | 5.89 | 90 (0) |
|  | F9 | medium | 0.21 | 0.25 | 73.2 | 4.85[1] | 60 (30) |
|  | C38 | low | 0.23 | 0.58+ | 68.2 | 1.32[1] | 40 (30) |
|  | B16F10-OVA | low | 0.37 | n.d. | 59.0 | 6.14 | 0 (0) |
| Non-resp. Models | 4T1 | medium | 0.90 | >0.9** | 37.1 | 2.37 | 0 (0) |
|  | B16F10 | low | 0.95 | >0.9** | 7.5 | 1.39 | 0 (0) |

Example 12.7.2: Correlation Between Anti-Tumor Response and mRNA Biomarker for Stratification or Disease Control Mean gene expression (RNA-seq) in early untreated tumors (100-200 mm³ in size, N=10 per model), larger untreated tumors (500 and 1000 mm³) or at the end of the study was correlated with T/C ratios of 21 syngeneic mouse models treated with TPP-14099 or TPP-15285 as described elsewhere herein.

Top correlated genes were found to be significantly enriched with T cell and inflammation markers (pearson correlation values), cf. Table 12.7.2.1. Inflammation marker IFNg and IFNg response genes (e.g. Gbp3/4/5/8/9, Cxcl9, Acod1), PDL1 (CD276), C1 complement factors, T cell genes such as Klra3/5, and Trav, as well as Treg markers CD25 (IL2RA), FOXP3, and CTLA4 are among the genes most correlated with response.

Table 12.7.2.2 shows fold change of expression in responder cell lines (T/C<0.6) versus non-responder cell lines (T/C>0.6) for early untreated tumors. The 100 genes with largest expression fold change between responders and non-responders are listed. IFNg and IFNg response genes (e.g. Gbp2/3/4/8/10/11, Cxcl9/11, Ubd), cytotoxic T cell markers (e.g. Granzymes, Prf1), as well as Mast cell markers (Tpsab1, Cma1, Tpsb2), and C1 complement factors are among the genes most predictive of response.

Table 12.7.2.3 shows fold change of expression in responder cell lines (T/C<0.6) versus non-responder cell lines (T/C >0.6) for larger untreated tumors (500 and 1000 mm³).

Biomarker candidates are listed in Table 12.7.2.1, 12.7.2.2 and 12.7.2.3. Patients with high expression of the human counterparts of these genes or a combination or signature of the human counterparts of these genes can thus be expected to respond to anti-CCR8 treatment in the clinic. Furthermore, these markers or their combination can also be used to monitor the treatment success. Biomarkers derived from genes in italics/bold are particularly preferred.

TABLE 12.7.2.1

Suitable biomarkers correlating with anti-tumor response achieved with inventive anti-CCR8 antibodies. These biomarkers were found upregulated in early untreated tumors and correlated with treatment response. Biomarker derived from genes in italics/bold are particularly preferred. The 100 genes with largest negative correlation coefficient (r values are shown) between expression and TIC ratios are listed.

| Gene | R | Gene | R | Gene | R | Gene | R |
|---|---|---|---|---|---|---|---|
| Grin2d | −0.658 | Fkbp15 | −0.583 | Cfb | −0.558 | Dnah7a | −0.539 |
| Olfr1395 | −0.656 | *Irf1* | −0.582 | Prm1 | −0.556 | Yipf4 | −0.538 |
| Olfr1122 | −0.655 | Eif3h | −0.579 | *Gbp5* | −0.556 | *C1ra* | −0.538 |
| *Gbp* | −0.638 | Rab8a | −0.578 | Stat1 | −0.556 | *Trav9n-1* | −0.534 |
| Mir8098 | −0.626 | Xpa | −0.578 | Nfkbiz | −0.554 | Ccdc9 | −0.533 |
| *Ifng* | −0.62 | Suox | −0.578 | *Klra5* | −0.553 | *Gbp3* | −0.533 |
| Eny2 | −0.618 | Scgb1b30 | −0.578 | Ano8 | −0.552 | *Foxp3* | −0.533 |
| Hebp1 | −0.614 | Rarres2 | −0.574 | Slc12a9 | −0.552 | Epb4l1a | −0.533 |
| *Cd274* | −0.614 | Ywhag | −0.573 | Nr1h2 | −0.552 | *Klra3* | −0.533 |
| *Gbp10* | −0.613 | Fgl2 | −0.573 | Aip | −0.552 | *Il15* | −0.532 |
| Esyt2 | −0.611 | Wdtc1 | −0.572 | Shisa5 | −0.551 | Myo1e | −0.529 |
| Clic6 | −0.607 | *Ctla4* | −0.571 | Bcl2a1c | −0.55 | Wdr60 | −0.529 |
| Greb1l | −0.606 | Batf2 | −0.571 | Fam32a | −0.548 | Trim56 | −0.528 |
| *Trav7d-3* | −0.604 | Olfr56 | −0.571 | Tatdn1 | −0.547 | Ppp1r15a | −0.526 |
| Pinc | −0.603 | Cnep1r1 | −0.571 | Cd200r4 | −0.547 | Iigp1 | −0.526 |
| Cenpt | −0.602 | Empl1 | −0.57 | *Gbp4* | −0.546 | Fes | −0.524 |
| *Cxcl9* | −0.601 | Klf4 | −0.567 | *Ccl8* | −0.545 | Trim12c | −0.523 |
| Fam26f | −0.6 | Hrh4 | −0.566 | Ttc39c | −0.544 | Psmg4 | −0.523 |
| *Il2ra* | −0.6 | Gbp9 | −0.566 | Klk10 | −0.544 | Igfbp5 | −0.521 |
| Hectd2 | −0.596 | Nlrp9c | −0.565 | Crybg1 | −0.543 | Itgb1 | −0.52 |
| Chmp5 | −0.593 | Fam129b | −0.564 | Gnb2 | −0.542 | Klf9 | −0.518 |
| Pcdhb22 | −0.59 | *Tlr6* | −0.562 | Ctsg | −0.542 | Actr1a | −0.518 |
| Slitrk4 | −0.589 | *Icos* | −0.562 | Olfr1396 | −0.542 | *Sh2d1a* | −0.517 |
| *Il8bp* | −0.586 | Tmsb15a | −0.56 | Acod1 | −0.54 | Siah1a | −0.516 |
| Cyth2 | −0.585 | Pla2g15 | −0.559 | ENS87554 | −0.54 | *Ccl11* | −0.516 |

TABLE 12.7.2.

Suitable biomarkers correlating with anti-tumor response achieved with inventive anti-CCR8 antibodies. Fold change of expression in responder cell lines (TIC < 0.6) versus non-responder cell lines (T/C > 0.6). Top correlated (pearson) genes were found significantly enriched with T cell and inflammation markers.

| Gene | Log-fold change | Gene | Log-fold change | Gene | Log-fold change | Gene | Log-fold change |
|---|---|---|---|---|---|---|---|
| *Gbp2b* | 4.6 | Serpinb9b | 2.6 | Prkg2 | 2.2 | Pak3 | 2.0 |
| Msln | 4.4 | *Gbp4* | 2.5 | Batf2 | 2.2 | *C1rb* | 2.0 |
| Klk10 | 4.2 | Itgb4 | 2.5 | Nppb | 2.2 | Itgb11 | 2.0 |
| Mcpt2 | 3.5 | *Gzmf* | 2.5 | *C1s2* | 2.2 | Serpina3g | 2.0 |
| *Gbp10* | 3.4 | *Gzmd* | 2.5 | Dio2 | 2.2 | Itih2 | 2.0 |
| Foxg1 | 3.2 | AW112010 | 2.5 | Bdnf | 2.2 | *Tpsb2* | 2.0 |
| *Tpsab1* | 3.2 | *Ido2* | 2.5 | Itgb6 | 2.2 | Phex | 2.0 |
| *Ifi44l* | 3.1 | *Gbp2* | 2.4 | Ar | 2.2 | Hal | 2.0 |
| Syt8 | 3.1 | Iigp1 | 2.4 | Tgtp2 | 2.2 | Clcf1 | 2.0 |
| *Cxcl9* | 3.0 | Notum | 2.4 | Tnni2 | 2.2 | *Ifi47* | 2.0 |
| Hectd2 | 2.9 | *Gbp3* | 2.4 | Styk1 | 2.1 | Fam26f | 2.0 |
| Lgals7 | 2.9 | Tgtp1 | 2.4 | H19 | 2.1 | *Trbc1* | 2.0 |
| *Ido1* | 2.8 | *Cxcl11* | 2.4 | Rpl391 | 2.1 | Il34 | 2.0 |
| Zfpm2 | 2.8 | Irx2 | 2.3 | Inhba | 2.1 | Serpina3f | 2.0 |
| Dynap | 2.7 | Tmem200a | 2.3 | Zfp985 | 2.1 | Grem1 | 2.0 |
| Cdh17 | 2.7 | *Ifng* | 2.3 | S100a7a | 2.1 | Btc | 2.0 |
| Gzmb | 2.7 | Klhdc8a | 2.3 | Olfr56 | 2.1 | Sox9 | 2.0 |
| Ubd | 2.7 | Fst | 2.3 | Gjb4 | 2.1 | Klf4 | 1.9 |
| *Gbp11* | 2.6 | Trpm6 | 2.3 | *Nkg7* | 2.1 | Pi15 | 1.9 |
| Mcpt1 | 2.6 | Syt12 | 2.3 | Ankrd1 | 2.1 | Slit2 | 1.9 |
| Gzmg | 2.6 | *Gbp5* | 2.3 | Rab27b | 2.0 | Gprc5a | 1.9 |
| *Ifi202b* | 2.6 | Cntnap4 | 2.3 | Klf5 | 2.0 | *Gbp8* | 1.9 |
| Greb11 | 2.6 | *Gzmc* | 2.3 | Eps812 | 2.0 | *Cma1* | 1.9 |
| Brinp3 | 2.6 | *Prf1* | 2.3 | Epb4114a | 2.0 | Mgp | 1.9 |

TABLE 12.7.2.3

Suitable biomarkers based on genes with largest fold changes between responders and non-responders based on large untreated tumors (500 mm³ and 1000 mm³). Expression of granzymes & other immune cell markers is higher in responders than non-responder models. Biomarker derived from genes in italics/bold are particularly preferred.

| Gene | Log-fold change | Gene | Log-fold change | Gene | Log-fold change | Gene | Log-fold change | Gene | Log-fold change |
|---|---|---|---|---|---|---|---|---|---|
| Foxg1 | 4.6 | Itgb4 | 2.9 | Sorcs2 | 2.5 | Aicda | 2.3 | Fas | 2.0 |
| Msln | 4.5 | Rarres1 | 2.9 | *Gzmc* | 2.5 | Lhx2 | 2.3 | Klk4 | 2.0 |
| Zfpm2 | 4.3 | Dcn | 2.9 | Prrx2 | 2.5 | Dpep1 | 2.3 | Sema5 a | 2.0 |
| Klk10 | 4.2 | Osr1 | 2.8 | Lef1 | 2.5 | Lancl3 | 2.3 | Lrch2 | 2.0 |
| Dynap | 4.0 | Inhba | 2.8 | Ighg1 | 2.5 | Ereg | 2.2 | Fam189a1 | 2.0 |
| Ar | 3.8 | Greb11 | 2.8 | Chrna1 | 2.5 | Foxa1 | 2.2 | *Tpsb2* | 2.0 |
| Fst | 3.6 | Bdnf | 2.8 | Ighg2b | 2.5 | Ighg2c | 2.2 | Shank1 | 2.0 |
| Syt8 | 3.5 | Wnt10a | 2.7 | Omd | 2.5 | Dmrta1 | 2.2 | Dsc2 | 2.0 |
| Hectd2 | 3.4 | Prkg2 | 2.7 | Sema3c | 2.5 | Cavin2 | 2.2 | Gpm6b | 2.0 |
| Pi15 | 3.4 | Slc24a3 | 2.7 | Epb4114a | 2.5 | Grem1 | 2.2 | Slc12a1 | 2.0 |
| Foxd1 | 3.4 | Ptgs2 | 2.7 | *Gzme* | 2.5 | Fam83f | 2.2 | Plut | 2.0 |
| *Gzmf* | 3.3 | Arsj | 2.7 | Ngef | 2.5 | Pak3 | 2.2 | *Gzmb* | 2.0 |
| Zic5 | 3.2 | Itgb8 | 2.7 | Trp63 | 2.4 | H19 | 2.2 | Prelp | 2.0 |
| Igf2 | 3.1 | Sh3rf3 | 2.7 | Klhdc8a | 2.4 | Slit2 | 2.2 | *Gbp4* | 2.0 |
| *Gzmg* | 3.1 | Medag | 2.7 | Slurp1 | 2.4 | Bmp4 | 2.1 | Rnf165 | 2.0 |
| Itgbl1 | 3.1 | Tnni2 | 2.7 | Tpsab1 | 2.4 | Grin2d | 2.1 | Syt12 | 2.0 |
| Tmem200a | 3.1 | Cntnap4 | 2.7 | Pdx1 | 2.4 | Ifi202b | 2.1 | Btc | 2.0 |
| Dio2 | 3.0 | Sema3a | 2.6 | Pdgfra | 2.4 | Kirrel3 | 2.1 | Tssk6 | 2.0 |
| *Gzmd* | 3.0 | Ptgs2os2 | 2.6 | Dkk2 | 2.4 | Podnl1 | 2.1 | Slit3 | 2.0 |
| Aldh3a1 | 3.0 | Anxa8 | 2.6 | Cavin4 | 2.4 | *Prf1* | 2.1 | Gcsam | 2.0 |
| Scara3 | 3.0 | Rpl391 | 2.6 | Kenu1 | 2.4 | Lg als7 | 2.1 | *Il11* | 2.0 |
| *Il33* | 2.9 | Pcdh19 | 2.6 | Xlr | 2.4 | *Gbp10* | 2.1 | Sybu | 2.0 |
| Brinp3 | 2.9 | Ltbp1 | 2.6 | Cdh17 | 2.3 | *Gbp8* | 2.1 | Mrgprf | 2.0 |
| Pcdhgb1 | 2.9 | *Gbp2b* | 2.5 | Ighg3 | 2.3 | Cdy12 | 2.1 | Irx2 | 2.0 |

Example 12.8: Altered mRNA Expression in Syngeneic Tumor Models after Administration of Anti-CCR8 Antibody For each syngeneic tumor model, 10 mice treated with anti-CCR8 antibody TPP-14099 and 10 mice treated with isotype control were sacrificed 24h past final treatment. Tumors were cut into small pieces and immersed in RNAlater at 4° C. Poly-A mRNA was extracted and cDNA libraries were generated according to Illumina's Hi-seq protocol for subsequent RNA-sequencing. Samples were sequenced to a depth of ~40 million 150 bp long paired end reads/sample.

FIGS. 63 to 73 show the impact of treatment with either isotype control (TPP-9809) or anti-CCR8 antibody (TPP-14099) on the mRNA expression levels of different immune cell markers in different syngeneic tumor models. The treatment increased inflammation marker ling, macrophage markers Ms4a7, Acod1 and Mrc1, cytotoxic T cell markers Cd8a and Cd8b1, Natural killer (NK) cell marker Ncr1, pan T cell markers Cd3e/d/g and B cell markers Cd19 and Cd22.

Remarkably, the inventors observed significant induction of LTta/b as well as Cxcr5 and its ligand Cxcl13 in the CT26, MBT2 and H22 tumor models, as well as a general upregulation of these genes in several other models including RM1, Hepa1-6, and 4T1. Without being bound by theory, an induction of tertiary lymphoid structures by anti-CCR8 antibody TPP-14099 or TPP-15285 may contribute to the anti-tumor response elicited by these antibodies.

TABLE 12.8.1

Anti-correlation of T cell marker, checkpoint proteins, Treg markers, NK cell marker, macrophage marker, B cell marker and interferon gamma with anti-CCR8 antibody treatment response.

|     |        | Cd8a   | Cd274 [PD-L1] | Pdcd1 [PD-1] | Ctla4  | Ccr4   | Ccr8   | Foxp3  | Ncr1   | Ms4a7  | Fcgr2b | Ifng   |
|-----|--------|--------|---------------|--------------|--------|--------|--------|--------|--------|--------|--------|--------|
| CT26 | r      | −0.693 | −0.630        | −0.600       | −0.654 | −0.612 | −0.664 | −0.531 | −0.775 | −0.626 | −0.496 | −0.606 |
|     | pvalue | 0.026  | 0.051         | 0.067        | 0.040  | 0.060  | 0.036  | 0.114  | 0.008  | 0.053  | 0.145  | 0.063  |
| H22 | r      | −0.791 | −0.782        | −0.852       | −0.804 | −0.779 | −0.888 | −0.828 | −0.738 | −0.686 | −0.710 | −0.896 |
|     | pvalue | 0.011  | 0.013         | 0.004        | 0.009  | 0.013  | 0.001  | 0.006  | 0.023  | 0.041  | 0.032  | 0.001  |

Example 13: Preparation of Targeted Thorium Conjugate (TTC) Comprising Anti-CCR8 Antibodies The disclosure of WO2016096843 is incorporated herein by reference in its entirety and in particular with regard to the production of the conjugates as described in this example.

Conjugation of the 3,2-hydroxypiridonone (3,2-HOPO) chelator or any other suitable chelator to the antibodies TPP-23411, TPP-21360 or any other anti-CCR8 antibodies described can be conducted as previously described in patent application WO2016096843. Briefly, to activate the chelator, the 3,2-HOPO chelator, dissolved in DMA at a 1:1 ratio with 0.1 M MES buffer pH 5.4, NHS and EDC, both dissolved in 0.1 M MES buffer pH 5.4, is mixed at a ratio of 1/1/3. For conjugation to the antibodies, a molar ratio of 7.5/7.5/22.5/1 (chelator/NHS/EDC/mAb) of the activated chelator can be charged to mAb. After 20-60 min, the reaction is quenched with 12% v/v 0.3 M citric acid to adjust pH to 5.5. The protein concentration is determined by HPLC, integrating the peak area at an absorbance of 280 nm. The solution is then buffer exchanged into 30 mM Citrate, 50 mg/mlx M sucrose, 2 mM EDTA, 0.5 mg/ml pABA, pH 5.5 by Tangential Flow Filtration (TFF) at constant volume. At the end of the diafiltration, the solution is discharged to a formulation container. The product is formulated with TFF buffer (30 mM Citrate, ×50 mg/ml M Sucrose, 2 mM EDTA, 0.5 mg/ml pABA, pH 5.5) and 7% w/v polysorbate 80 to obtain 2.5 mg/ml of respective CCR8 antibody-chelator conjugates (CCR8-ACCs). CCR8-ACCs can be filtered through a 0.2 μm filter into sterile vials.

CCR8-ACCs are radiolabeled with thorium-227 as described in WO2016096843. Briefly, 5 μl of CCR8-ACCs are mixed with 32 μl of thorium-227 (activity of 3.875 MBq/ml) and 13 μl of citrate buffer, resulting in CCR8-targeted thorium-227 conjugates (CCR8-TTCs) at specific activities of 10 kBq/μs. The sample can be incubated for 60 min at room temperature to allow for stable radiolabeling of thorium-227 into the 3,2-HOPO chelator. An aliquot of the sample can be analyzed by instant thin layer chromatography (iTLC).

ANTIBODY SEQUENCES

SEQ ID Sequence

201 EVQLLESGGGLVQPGGSLRLSCAASGFTFSSYGMHWVRQAPGKGLEWVSAISGSGGSTY
YADSVKGRFTISRDNSKNTLYLQMNSLRAEDTAVYYCARGRQLGSWGQGTLVTVSS

202 SYGMH

203 AISGSGGSTYYADSVKG

204 GRQLGS

205 QSVLTQPPSASGTPGQRVTISCSGSSSNIGSNYVYWYQQLPGTAPKLLIYGNNNRPSGVPD
RFSGSKSGTSASLAISGLRSEDEADYYCAAWDDSLNGWVFGGGTKLTVL

206 SGSSSNIGSNYVY

207 GNNNRPS

208 AAWDDSLNGWV

209 GAAGTTCAGCTGCTGGAATCTGGCGGCGGACTGGTTCAACCTGGCGGATCTCTGAGAC
TGAGCTGTGCCGCCAGCGGCTTCACCTTTAGCAGCTATGGCATGCACTGGGTCCGACA
GGCCCCTGGCAAAGGACTTGAATGGGTGTCCGCCATCTCTGGCAGCGGCGGCAGCAC
ATATTACGCCGATTCTGTGAAGGGCAGATTCACCATCAGCCGGGACAACAGCAAGAA
CACCCTGTACCTGCAGATGAACAGCCTGAGAGCCGAGGACACCGCCGTGTACTATTGT
GCCAGAGGCAGACAGCTCGGCTCTTGGGGACAGGGAACACTGGTTACAGTGTCCTCA

210 CAGTCTGTTCTGACACAGCCTCCTAGCGCCTCTGGCACACCTGGACAGAGAGTGACCA
TCAGCTGTAGCGGCAGCAGCTCCAACATCGGCAGCAACTACGTGTACTGGTATCAGCA
GCTGCCCGGCACAGCCCCTAAACTGCTGATCTACGGCAACAACAACAGACCCAGCGG
CGTGCCCGATAGATTCAGCGGCTCTAAGTCTGGCACAAGCGCCAGCCTGGCCATCTCT
GGACTGAGATCTGAGGACGAGGCCGACTACTATTGCGCCGCCTGGGACGATTCTCTGA
ACGGCTGGGTTTTCGGCGGAGGCACCAAACTGACAGTGCTA

211 EVQLLESGGGLVQPGGSLRLSCAASGFTFSSYGMHWVRQAPGKGLEWVSAISGSGGSTY
YADSVKGRFTISRDNSKNTLYLQMNSLRAEDTAVYYCARGRQLGSWGQGTLVTVSSAST
KGPSVFPLAPSSKSTSGGTAALGCLVKDYFPEPVTVSWNSGALTSGVHTFPAVLQSSGLYS
LSSVVTVPSSSLGTQTYICNVNHKPSNTKVDKKVEPKSCDKTHTCPPCPAPELLGGPSVFLF
PPKPKDTLMISRTPEVTCVVVDVSHEDPEVKFNWYVDGVEVHNAKTKPREEQYNSTYRV
VSVLTVLHQDWLNGKEYKCKVSNKALPAPIEKTISKAKGQPREPQVYTLPPSRDELTKNQ
VSLTCLVKGFYPSDIAVEWESNGQPENNYKTTPPVLDSDGSFFLYSKLTVDKSRWQQGNV
FSCSVMHEALHNHYTQKSLSLSPG

212 QSVLTQPPSASGTPGQRVTISCSGSSSNIGSNYVYWYQQLPGTAPKLLIYGNNNRPSGVPD
RFSGSKSGTSASLAISGLRSEDEADYYCAAWDDSLNGWVFGGGTKLTVLGQPKAAPSVTL
FPPSSEELQANKATLVCLISDFYPGAVTVAWKADSSPVKAGVETTTPSKQSNNKYAASSY
LSLTPEQWKSHRSYSCQVTHEGSTVEKTVAPTECS

213 GAAGTTCAGCTGCTGGAATCTGGCGGCGGACTGGTTCAACCTGGCGGATCTCTGAGAC
TGAGCTGTGCCGCCAGCGGCTTCACCTTTAGCAGCTATGGCATGCACTGGGTCCGACA
GGCCCCTGGCAAAGGACTTGAATGGGTGTCCGCCATCTCTGGCAGCGGCGGCAGCAC
ATATTACGCCGATTCTGTGAAGGGCAGATTCACCATCAGCCGGGACAACAGCAAGAA
CACCCTGTACCTGCAGATGAACAGCCTGAGAGCCGAGGACACCGCCGTGTACTATTGT
GCCAGAGGCAGACAGCTCGGCTCTTGGGGACAGGGAACACTGGTTACAGTGTCCTCA
GCCAGCACCAAGGGCCCCAGCGTGTTCCCTCTGGCCCCTAGCAGCAAGAGCACATCTG
GCGGAACAGCCGCCCTGGGCTGCCTCGTGAAGGACTACTTTCCCGAGCCCGTGACCGT
GTCCTGGAACTCTGGCGCTCTGACAAGCGGCGTGCACACCTTTCCAGCCGTGCTGCAG
AGCAGCGGCCTGTACTCTCTGAGCAGCGTCGTGACAGTGCCCAGCAGCTCTCTGGGCA
CCCAGACCTACATCTGCAACGTGAACCACAAGCCCAGCAACACCAAGGTGGACAAGA
AGGTGGAACCCAAGAGCTGCGACAAGACCCACACCTGTCCCCCTTGTCCTGCCCCCGA
ACTGCTGGGAGGCCCTTCCGTGTTCCTGTTCCCCCCAAAGCCCAAGGACACCCTGATG
ATCAGCCGGACCCCCGAAGTGACCTGCGTGGTGGTGGATGTGTCCCACGAGGACCCTG
AAGTGAAGTTCAATTGGTACGTGGACGGCGTGGAAGTGCACAACGCCAAGACCAAGC
CTAGAGAGGAACAGTACAACAGCACCTACCGGGTGGTGTCCGTGCTGACAGTGCTGC
ACCAGGACTGGCTGAACGGCAAAGAGTACAAGTGCAAGGTGTCCAACAAGGCCCTGC
CTGCCCCCATCGAGAAAACCATCAGCAAGGCCAAGGGCCAGCCCCGCGAACCCCAGG
TGTACACACTGCCCCCAAGCAGGGACGAGCTGACCAAGAACCAGGTGTCCCTGACCT
GTCTCGTGAAAGGCTTCTACCCCTCCGATATCGCCGTGGAATGGGAGAGCAACGGCCA
GCCCGAGAACAACTACAAGACCACCCCCCCTGTGCTGGACAGCGACGGCTCATTCTTC
CTGTACAGCAAGCTGACCGTGGACAAGTCCCGGTGGCAGCAGGGCAACGTGTTCAGC
TGCAGCGTGATGCACGAGGCCCTGCACAACCACTACACCCAGAAGTCCCTGAGCCTG
AGCCCTGGC

214 CAGTCTGTTCTGACACAGCCTCCTAGCGCCTCTGGCACACCTGGACAGAGAGTGACCA
TCAGCTGTAGCGGCAGCAGCTCCAACATCGGCAGCAACTACGTGTACTGGTATCAGCA
GCTGCCCGGCACAGCCCCTAAACTGCTGATCTACGGCAACAACAACAGACCCAGCGG
CGTGCCCGATAGATTCAGCGGCTCTAAGTCTGGCACAAGCGCCAGCCTGGCCATCTCT
GGACTGAGATCTGAGGACGAGGCCGACTACTATTGCGCCGCCTGGGACGATTCTCTGA

ANTIBODY SEQUENCES

| SEQ ID | Sequence |
|---|---|
| | ACGGCTGGGTTTTCGGCGGAGGCACCAAACTGACAGTGCTAGGCCAGCCTAAAGCCG<br>CCCCTAGCGTGACCCTGTTCCCTCCAAGCAGCGAGGAACTGCAGGCCAACAAGGCCA<br>CCCTCGTGTGCCTGATCAGCGACTTCTATCCTGGCGCCGTGACCGTGGCCTGGAAGGC<br>CGATAGCTCTCCTGTGAAGGCCGGCGTGGAAACCACCACCCCTAGCAAGCAGAGCAA<br>CAACAAATACGCCGCCAGCAGCTACCTGAGCCTGACCCCCGAGCAGTGGAAGTCCCA<br>CAGATCCTACAGCTGCCAAGTGACCCACGAGGGCAGCACCGTGGAAAAGACAGTGGC<br>CCCTACCGAGTGCAGC |
| 215 | EVQLLESGGGLVQPGGSLRLSCAASGFTFSDYGVHWVRQAPGKGLEWVSGVSWNGSRT<br>HYADSVKGRFTISRDNSKNTLYLQMNSLRAEDTAVYYCVTRGAWGQGTLVTVSS |
| 216 | DYGVH |
| 217 | GVSWNGSRTHYADSVKG |
| 218 | RGA |
| 219 | QSVLTQPPSASGTPGQRVTISCSGSSFNIGSHFVYWYQQLPGTAPKLLIYKNNQRPSGVPDR<br>FSGSKSGTSASLAISGLRSEDEADYYCAAWDDSLNGPVFGGGTKLTVL |
| 220 | SGSSFNIGSHFVY |
| 221 | KNNQRPS |
| 222 | AAWDDSLNGPV |
| 223 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCGATTATGGCGTGCACTGGGTCCGACA<br>GGCCCCTGGAAAAGGACTGGAATGGGTTTCAGGCGTGTCCTGGAACGGCAGCAGAAC<br>CCACTATGCCGACAGCGTGAAGGGCAGATTCACCATCAGCCGGGACAACAGCAAGAA<br>CACCCTGTACCTGCAGATGAACAGCCTGAGAGCCGAGGACACCGCCGTGTACTACTGT<br>GTGACAAGAGGCGCTTGGGGCCAGGGCACACTGGTCACAGTTTCTTCA |
| 224 | CAGTCTGTTCTGACACAGCCTCCTAGCGCCTCTGGCACACCTGGACAGAGAGTGACCA<br>TCAGCTGTAGCGGCAGCAGCTTCAACATCGGCAGCCACTTCGTGTACTGGTATCAGCA<br>GCTGCCTGGCACAGCCCCTAAACTGCTGATCTACAAGAACAACCAGCGGCCTAGCGG<br>CGTGCCCGATAGATTTTCTGGCAGCAAGAGCGGCACAAGCGCCAGCCTGGCTATCTCT<br>GGACTGAGATCTGAGGACGAGGCCGACTACTATTGCGCCGCCTGGGACGATTCTCTGA<br>ACGGCCCTGTTTTTGGCGGAGGCACCAAGCTGACAGTGCTA |
| 225 | EVQLLESGGGLVQPGGSLRLSCAASGFTFSDYGVHWVRQAPGKGLEWVSGVSWNGSRT<br>HYADSVKGRFTISRDNSKNTLYLQMNSLRAEDTAVYYCVTRGAWGQGTLVTVSSASTKG<br>PSVFPLAPSSKSTSGGTAALGCLVKDYFPEPVTVSWNSGALTSGVHTFPAVLQSSGLYSLS<br>SVVTVPSSSLGTQTYICNVNHKPSNTKVDKKVEPKSCDKTHTCPPCPAPELLGGPSVFLFPP<br>KPKDTLMISRTPEVTCVVVDVSHEDPEVKFNWYVDGVEVHNAKTKPREEQYNSTYRVVS<br>VLTVLHQDWLNGKEYKCKVSNKALPAPIEKTISKAKGQPREPQVYTLPPSRDELTKNQVS<br>LTCLVKGFYPSDIAVEWESNGQPENNYKTTPPVLDSDGSFFLYSKLTVDKSRWQQGNVFS<br>CSVMHEALHNHYTQKSLSLSPG |
| 226 | QSVLTQPPSASGTPGQRVTISCSGSSFNIGSHFVYWYQQLPGTAPKLLIYKNNQRPSGVPDR<br>FSGSKSGTSASLAISGLRSEDEADYYCAAWDDSLNGPVFGGGTKLTVLGQPKAAPSVTLFP<br>PSSEELQANKATLVCLISDFYPGAVTVAWKADSSPVKAGVETTTPSKQSNNKYAASSYLS<br>LTPEQWKSHRSYSCQVTHEGSTVEKTVAPTECS |
| 227 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCGATTATGGCGTGCACTGGGTCCGACA<br>GGCCCCTGGAAAAGGACTGGAATGGGTTTCAGGCGTGTCCTGGAACGGCAGCAGAAC<br>CCACTATGCCGACAGCGTGAAGGGCAGATTCACCATCAGCCGGGACAACAGCAAGAA<br>CACCCTGTACCTGCAGATGAACAGCCTGAGAGCCGAGGACACCGCCGTGTACTACTGT<br>GTGACAAGAGGCGCTTGGGGCCAGGGCACACTGGTCACAGTTTCTTCAGCCAGCACC<br>AAGGGCCCCAGCGTGTTCCCTCTGGCCCCTAGCAGCAAGAGCACATCTGGCGGAACA<br>GCCGCCCTGGGCTGCCTCGTGAAGGACTACTTTCCCGAGCCCGTGACCGTGTCCTGGA<br>ACTCTGGCGCTCTGACAAGCGGCGTGCACACCTTTCCAGCCGTGCTGCAGAGCAGCGG<br>CCTGTACTCTCTGAGCAGCGTCGTGACAGTGCCCAGCAGCTCTCTGGGCACCCAGACC<br>TACATCTGCAACGTGAACCACAAGCCCAGCAACACCAAGGTGGACAAGAAGGTGGAA<br>CCCAAGAGCTGCGACAAGACCCACACCTGTCCCCCTTGTCCTGCCCCCGAACTGCTGG<br>GAGGGCCCTTCCGTGTTCCTGTTCCCCCCAAAGCCCAAGGACACCCTGATGATCAGCCG<br>GACCCCCGAAGTGACCTGCGTGGTGGTGGATGTGTCCCACGAGGACCCTGAAGTGAA<br>GTTCAATTGGTACGTGGACGGCGTGGAAGTGCACAACGCCAAGACCAAGCCTAGAGA<br>GGAACAGTACAACAGCACCTACCGGGTGGTGTCCGTGCTGACAGTGCTGCACCAGGA<br>CTGGCTGAACGGCAAAGAGTACAAGTGCAAGGTGTCCAACAAGGCCCTGCCTGCCCC<br>CATCGAGAAACCATCAGCAAGGCCAAGGGCCAGCCCCGCGAACCCCAGGTGTACAC<br>ACTGCCCCCAAGCAGGGACGAGCTGACCAAGAACCAGGTGTCCCTGACCTGTCTCGTG<br>AAAGGCTTCTACCCCTCCGATATCGCCGTGGAATGGGAGAGCAACGGCCAGCCCGAG |

ANTIBODY SEQUENCES

| SEQ ID | Sequence |
|---|---|
| | AACAACTACAAGACCACCCCCCCTGTGCTGGACAGCGACGGCTCATTCTTCCTGTACA<br>GCAAGCTGACCGTGGACAAGTCCCGGTGGCAGCAGGGCAACGTGTTCAGCTGCAGCG<br>TGATGCACGAGGCCCTGCACAACCACTACACCCAGAAGTCCCTGAGCCTGAGCCCTGG<br>C |
| 228 | CAGTCTGTTCTGACACAGCCTCCTAGCGCCTCTGGCACACCTGGACAGAGAGTGACCA<br>TCAGCTGTAGCGGCAGCAGCTTCAACATCGGCAGCCACTTCGTGTACTGGTATCAGCA<br>GCTGCCTGGCACAGCCCCTAAACTGCTGATCTACAAGAACAACCAGCGGCCTAGCGG<br>CGTGCCCGATAGATTTTCTGGCAGCAAGAGCGGCACAAGCGCCAGCCTGGCTATCTCT<br>GGACTGAGATCTGAGGACGAGGCCGACTACTATTGCGCCGCCTGGGACGATTCTCTGA<br>ACGGCCCTGTTTTTGGCGGAGGCACCAAGCTGACAGTGCTAGGCCAGCCTAAAGCCGC<br>CCCTAGCGTGACCCTGTTCCCTCCAAGCAGCGAGGAACTGCAGGCCAACAAGGCCAC<br>CCTCGTGTGCCTGATCAGCGACTTCTATCCTGGCGCCGTGACCGTGGCCTGGAAGGCC<br>GATAGCTCTCCTGTGAAGGCCGGCGTGGAAACCACCACCCCTAGCAAGCAGAGCAAC<br>AACAAATACGCCGCCAGCAGCTACCTGAGCCTGACCCCCGAGCAGTGGAAGTCCCAC<br>AGATCCTACAGCTGCCAAGTGACCCACGAGGGCAGCACCGTGGAAAAGACAGTGGCC<br>CCTACCGAGTGCAGC |
| 229 | EVQLLESGGGLVQPGGSLRLSCAASGFTFSDYGVHWVRQAPGKGLEWVSGVSWNGSRT<br>HYADSVKGRFTISRDNSKNTLYLQMNSLRAEDTAVYYCVTRGAWGQGTLVTVSS |
| 230 | DYGVH |
| 231 | GVSWNGSRTHYADSVKG |
| 232 | RGA |
| 233 | QSVLTQPPSASGTPGQRVTISCSGSSFNIGSHFVYWYQQLPGTAPKLLIYKNNQRPSGVPDR<br>FSGSKSGTSASLAISGLRSEDEADYYCAAWDDSLNGPVFGGGTKLTVL |
| 234 | SGSSFNIGSHFVY |
| 235 | KNNQRPS |
| 236 | AAWDDSLNGPV |
| 237 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCGATTATGGCGTGCACTGGGTCCGACA<br>GGCCCCTGGAAAAGGACTGGAATGGGTTTCAGGCGTGTCCTGGAACGGCAGCAGAAC<br>CCACTATGCCGACAGCGTGAAGGGCAGATTCACCATCAGCCGGGACAACAGCAAGAA<br>CACCCTGTACCTGCAGATGAACAGCCTGAGAGCCGAGGACACCGCCGTGTACTACTGT<br>GTGACAAGAGGCGCTTGGGGCCAGGGCACACTGGTCACAGTTTCTTCA |
| 238 | CAGTCTGTTCTGACACAGCCTCCTAGCGCCTCTGGCACACCTGGACAGAGAGTGACCA<br>TCAGCTGTAGCGGCAGCAGCTTCAACATCGGCAGCCACTTCGTGTACTGGTATCAGCA<br>GCTGCCTGGCACAGCCCCTAAACTGCTGATCTACAAGAACAACCAGCGGCCTAGCGG<br>CGTGCCCGATAGATTTTCTGGCAGCAAGAGCGGCACAAGCGCCAGCCTGGCTATCTCT<br>GGACTGAGATCTGAGGACGAGGCCGACTACTATTGCGCCGCCTGGGACGATTCTCTGA<br>ACGGCCCTGTTTTTGGCGGAGGCACCAAGCTGACAGTGCTA |
| 239 | EVQLLESGGGLVQPGGSLRLSCAASGFTFSDYGVHWVRQAPGKGLEWVSGVSWNGSRT<br>HYADSVKGRFTISRDNSKNTLYLQMNSLRAEDTAVYYCVTRGAWGQGTLVTVSSAKTTA<br>PSVYPLAPVCGDTTGSSVTLGCLVKGYFPEPVTLTWNSGSLSSGVHTFPAVLQSDLYTLSS<br>SVTVTSSTWPSQSITCNVAHPASSTKVDKKIEPRGPTIKPCPPCK-<br>CPAPNLLGGPSVFIFPPKI<br>KDVLMISLSPIVTCVVVDVSEDDPDVQISWFVNNVEVHTAQTQTHREDYNSTLRVVSALPI<br>QHQDWMSGKEFKCKVNNKDLPAPIERTISKPKGSVRAPQVYVLPPPEEEMTKKQVTLTC<br>MVTDFMPEDIYVEWTNNGKTELNYKNTEPVLDSDGSYFMYSKLRVEKKNWVERNSYSC<br>SVVHEGLHNHHTTKSFSRTPGK |
| 240 | QSVLTQPPSASGTPGQRVTISCSGSSFNIGSHFVYWYQQLPGTAPKLLIYKNNQRPSGVPDR<br>FSGSKSGTSASLAISGLRSEDEADYYCAAWDDSLNGPVFGGGTKLTVLGQPKSSPSVTLFP<br>PSSEELETNKATLVCTITDFYPGVVTVDWKVDGTPVTQGMETTQPSKQSNNKYMASSYLT<br>LTARAWERHSSYSCQVTHEGHTVEKSLSRADCS |
| 241 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCGATTATGGCGTGCACTGGGTCCGACA<br>GGCCCCTGGAAAAGGACTGGAATGGGTTTCAGGCGTGTCCTGGAACGGCAGCAGAAC<br>CCACTATGCCGACAGCGTGAAGGGCAGATTCACCATCAGCCGGGACAACAGCAAGAA<br>CACCCTGTACCTGCAGATGAACAGCCTGAGAGCCGAGGACACCGCCGTGTACTACTGT<br>GTGACAAGAGGCGCTTGGGGCCAGGGCACACTGGTCACAGTTTCTTCAGCCAAGACC |

ANTIBODY SEQUENCES

| SEQ ID | Sequence |
|---|---|
| | ACCGCCCCAGCGTGTACCCTCTGGCTCCTGTGTGTGGCGATACCACCGGCAGCTCTG<br>TGACCCTGGGCTGCCTCGTGAAGGGCTACTTCCCTGAGCCAGTGACCCTGACCTGGAA<br>CAGCGGCTCTCTGTCTAGCGGCGTGCACACCTTTCCAGCCGTGCTGCAGAGCGACCTG<br>TACACCCTGAGCAGCAGCGTGACCGTGACCAGCAGCACATGGCCCAGCCAGAGCATC<br>ACCTGTAACGTGGCCCACCCTGCCAGCTCCACCAAGGTGGACAAGAAGATCGAGCCC<br>AGAGGCCCCACCATCAAGCCTTGCCCCCCTTGCAAATGCCCTGCCCCAATCTGCTGG<br>GCGGACCCTCCGTGTTCATCTTCCCACCCAAGATCAAGGACGTGCTGATGATCAGCCT<br>GAGCCCCATCGTGACCTGCGTGGTGGTGGACGTGTCCGAGGACGACCCCGATGTGCA<br>GATCAGTTGGTTCGTGAACAACGTGGAAGTGCACACCGCCCAGACCCAGACACACAG<br>AGAGGACTACAACAGCACCCTGAGAGTGGTGTCCGCCCTGCCCATCCAGCACCAGGA<br>TTGGATGAGCGGCAAAGAGTTCAAGTGCAAAGTGAACAACAAGGACCTGCCAGCCCC<br>CATCGAGCGGACCATCTCTAAGCCTAAGGGCAGCGTGCGGGCTCCCCAGGTGTACGTG<br>CTGCCTCCTCAGAGGAAGATGACCAAGAAACAAGTGACACTGACATGCATGGTC<br>ACCGACTTCATGCCCGAGGACATCTACGTGGAATGGACCAACAACGGCAAGACCGAG<br>CTGAACTACAAGAACACCGAGCCCGTGCTGGACAGCGACGGCAGCTACTTCATGTAC<br>AGCAAGCTGCGGGTGGAAAAGAAAAACTGGGTGGAACGGAACAGCTACAGCTGCAG<br>CGTGGTGCACGAGGGCCTGCACAATCACCACACCACCAAGAGCTTCAGCCGGACCCC<br>TGGCAAG |
| 242 | CAGTCTGTTCTGACACAGCCTCCTAGCGCCTCTGGCACACCTGGACAGAGAGTGACCA<br>TCAGCTGTAGCGGCAGCAGCTTCAACATCGGCAGCCACTTCGTGTACTGGTATCAGCA<br>GCTGCCTGGCACAGCCCCTAAACTGCTGATCTACAAGAACAACCAGCGGCCTAGCGG<br>CGTGCCCGATAGATTTTCTGGCAGCAAGAGCGGCACAAGCGCCAGCCTGGCTATCTCT<br>GGACTGAGATCTGAGGACGAGGCCGACTACTATTGCGCCGCCTGGGACGATTCTCTGA<br>ACGGCCTGTTTTTGGCGGAGGCACCAAGCTGACAGTGCTAGGCCAGCCCAAGAGCA<br>GCCCTAGCGTGACCCTGTTCCCTCCAAGCAGCGAGGAACTGGAAACAAACAAGGCCA<br>CCCTCGTGTGCACCATCACCGACTTCTACCCCGGCGTCGTGACCGTGGACTGGAAGGT<br>GGACGGCACCCCAGTGACCCAGGGCATGGAAACCACCCAGCCCAGCAAGCAGAGCAA<br>CAACAAGTACATGGCCAGCAGCTACCTGACCCTGACCGCCAGAGCCTGGGAGAGACA<br>CAGCTCCTACAGCTGCCAAGTGACCCACGAGGGCCACACCGTGGAAAAGAGCCTGAG<br>CAGAGCCGACTGCAGC |
| 243 | EVQLLESGGGLVQPGGSLRLSCAASGFTFSSYGMHWVRQAPGKGLEWVSAISGSGGSTY<br>YADSVKGRFTISRDNSKNTLYLQMNSLRAEDTAVYYCARGRQLGSWGQGTLVTVSS |
| 244 | SYGMH |
| 245 | AISGSGGSTYYADSVKG |
| 246 | GRQLGS |
| 247 | QSVLTQPPSASGTPGQRVTISCSGSSSNIGSNYVYWYQQLPGTAPKLLIYGNNNRPSGVPD<br>RFSGSKSGTSASLAISGLRSEDEADYYCAAWDDSLNGWVFGGGTKLTVL |
| 248 | SGSSSNIGSNYVY |
| 249 | GNNNRPS |
| 250 | AAWDDSLNGWV |
| 251 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCTCTGGCAGCGGCGGCAGCAC<br>ATATTACGCCGATTCTGTGAAGGGCAGATTCACCATCAGCCGGGACAACAGCAAGAA<br>CACCCTGTACCTGCAGATGAACAGCCTGAGAGCCGAGGACACCGCCGTGTACTATTGT<br>GCCAGAGGCAGACAGCTCGGCTCTTGGGGACAGGGAACACTGGTTACAGTGTCCTCA |
| 252 | CAGTCTGTTCTGACACAGCCTCCTAGCGCCTCTGGCACACCTGGACAGAGAGTGACCA<br>TCAGCTGTAGCGGCAGCAGCTCCAACATCGGCAGCAACTACGTGTACTGGTATCAGCA<br>GCTGCCCGGCACAGCCCCTAAACTGCTGATCTACGGCAACAACAACAGACCCAGCGG<br>CGTGCCCGATAGATTCAGCGGCTCTAAGTCTGGCACAAGCGCCAGCCTGGCCATCTCT<br>GGACTGAGATCTGAGGACGAGGCCGACTACTATTGCGCCGCCTGGGACGATTCTCTGA<br>ACGGCTGGGTTTTCGGCGAGGCACCAAACTGACAGTGCTA |
| 253 | EVQLLESGGGLVQPGGSLRLSCAASGFTFSSYGMHWVRQAPGKGLEWVSAISGSGGSTY<br>YADSVKGRFTISRDNSKNTLYLQMNSLRAEDTAVYYCARGRQLGSWGQGTLVTVSSAKT<br>TAPSVYPLAPVCGDTTGSSVTLGCLVKGYFPEPVTLTWNSGSLSSGVHTFPAVLQSDLYTL<br>SSSVTVTSSTWPSQSITCNVAHPASSTKVDKKIEPRGPTIKPCPPCK-<br>CPAPNLLGGPSVFIFPP<br>KIKDVLMISLSPIVTCVVVDVSEDDPDVQISWFVNNVEVHTAQTQTHREDYNSTLRVVSA<br>LPIQHQDWMSGKEFKCKVNNKDLPAPIERTISKPKGSVRAPQVYVLPPPEEEMTKKQVTL<br>TCMVTDFMPEDIYVEWTNNGKTELNYKNTEPVLDSDGSYFMYSKLRVEKKNWVERNSY<br>SCSVVHEGLHNHHTTKSFSRTPGK |

ANTIBODY SEQUENCES

| SEQ ID | Sequence |
|---|---|
| 254 | QSVLTQPPSASGTPGQRVTISCSGSSSNIGSNYVYWYQQLPGTAPKLLIYGNNNRPSGVPD<br>RFSGSKSGTSASLAISGLRSEDEADYYCAAWDDSLNGWVFGGGTKLTVLGQPKSSPSVTL<br>FPPSSEELETNKATLVCTITDFYPGVVTVDWKVDGTPVTQGMETTQPSKQSNNKYMASSY<br>LTLTARAWERHSSYSCQVTHEGHTVEKSLSRADCS |
| 255 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCTCTGGCAGCGGCGGCAGCAC<br>ATATTACGCCGATTCTGTGAAGGGCAGATTCACCATCAGCCGGGACAACAGCAAGAA<br>CACCCTGTACCTGCAGATGAACAGCCTGAGAGCCGAGGACACCGCCGTGTACTATTGT<br>GCCAGAGGCAGACAGCTCGGCTCTTGGGGACAGGGAACACTGGTTACAGTGTCCTCA<br>GCCAAGACCACCGCCCCCAGCGTGTACCCTCTGGCTCCTGTGTGTGGCGATACCACCG<br>GCAGCTCTGTGACCCTGGGCTGCCTCGTGAAGGGCTACTTCCCTGAGCCAGTGACCCT<br>GACCTGGAACAGCGGCTCTCTGTCTAGCGGCGTGCACACCTTTCCAGCCGTGCTGCAG<br>AGCGACCTGTACACCCTGAGCAGCAGCGTGACCGTGACCAGCAGCACATGGCCCAGC<br>CAGAGCATCACCTGTAACGTGGCCCACCCTGCCAGCTCCACCAAGGTGGACAAGAAG<br>ATCGAGCCCAGAGGCCCCACCATCAAGCCTTGCCCCCCTTGCAAATGCCCTGCCCCCA<br>ATCTGCTGGGCGGACCCTCCGTGTTCATCTTCCCACCCAAGATCAAGGACGTGCTGAT<br>GATCAGCCTGAGCCCCATCGTGACCTGCGTGGTGGTGGACGTGTCCGAGGACGACCCC<br>GATGTGCAGATCAGTTGGTTCGTGAACAACGTGGAAGTGCACACCGCCCAGACCCAG<br>ACACACAGAGAGGACTACAACAGCACCCTGAGAGTGGTGTCCGCCCTGCCCATCCAG<br>CACCAGGATTGGATGAGCGGCAAAGAGTTCAAGTGCAAAGTGAACAACAAGGACCTG<br>CCAGCCCCATCGAGCGGACCATCTCTAAGCCTAAGGGCAGCGTGCGGGCTCCCCAG<br>GTGTACGTGCTGCCTCCTCCAGAGGAAGAGATGACCAAGAAACAAGTGACACTGACA<br>TGCATGGTCACCGACTTCATGCCCGAGGACATCTACGTGGAATGGACCAACAACGGC<br>AAGACCGAGCTGAACTACAAGAACACCGAGCCCGTGCTGGACAGCGACGGCAGCTAC<br>TTCATGTACAGCAAGCTGCGGGTGGAAAAGAAAAACTGGGTGGAACGGAACAGCTAC<br>AGCTGCAGCGTGGTGCACGAGGGCCTGCACAATCACCACACCACCAAGAGCTTCAGC<br>CGGACCCCTGGCAAG |
| 256 | CAGTCTGTTCTGACACAGCCTCCTAGCGCCTCTGGCACACCTGGACAGAGAGTGACCA<br>TCAGCTGTAGCGGCAGCAGCTCCAACATCGGCAGCAACTACGTGTACTGGTATCAGCA<br>GCTGCCCGGCACAGCCCCTAAACTGCTGATCTACGGCAACAACAACAGACCCAGCGG<br>CGTGCCCGATAGATTCAGCGGCTCTAAGTCTGGCACAAGCGCCAGCCTGGCCATCTCT<br>GGACTGAGATCTGAGGACGAGGCCGACTACTATTGCGCCGCCTGGGACGATTCTCTGA<br>ACGGCTGGGTTTTCGGCGGAGGCACCAAACTGACAGTGCTAGGCCAGCCCAAGAGCA<br>GCCCTAGCGTGACCCTGTTCCCTCCAAGCAGCGAGGAACTGGAAACAAACAAGGCCA<br>CCCTCGTGTGCACCATCACCGACTTCTACCCCGGCGTCGTGACCGTGGACTGGAAGGT<br>GGACGGCACCCCAGTGACCCAGGGCATGGAAACCACCCAGCCCAGCAAGCAGAGCAA<br>CAACAAGTACATGGCCAGCAGCTACCTGACCCTGACCGCCAGAGCCTGGGAGAGACA<br>CAGCTCCTACAGCTGCCAAGTGACCCACGAGGGCCACACCGTGGAAAAGAGCCTGAG<br>CAGAGCCGACTGCAGC |
| 257 | EVQLLESGGGLVQPGGSLRLSCAASGFTFSSYSMNWVRQAPGKGLEWVSGVSWAGSRTH<br>YADSVKGRFTISRDNSKNTLYLQMNSLRAEDTAVYYCARAAAGTRGFDYWGQGTLVTV<br>SS |
| 258 | SYSMN |
| 259 | GVSWAGSRTHYADSVKG |
| 260 | AAAGTRGFDY |
| 261 | QSVLTQPPSASGTPGQRVTISCSGSSSNIGSHIVNWYQQLPGTAPKLLIYGNTNRPSGVPDR<br>FSGSKSGTSASLAISGLRSEDEADYYCSSYTSISTLVFGGGTKLTVL |
| 262 | SGSSSNIGSHIVN |
| 263 | GNTNRPS |
| 264 | SSYTSISTLV |
| 265 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTACAGCATGAACTGGGTCCGACA<br>GGCCCCTGGCAAAGGCCTTGAATGGGTTTCAGGCGTGTCCTGGGCCGGCAGCAGAAC<br>CCACTATGCCGACAGCGTGAAGGGCAGATTCACCATCAGCCGGGACAACAGCAAGAA<br>CACCCTGTACCTGCAGATGAACAGCCTGAGAGCCGAGGACACCGCCGTGTACTATTGT<br>GCCAGAGCTGCCGCCGGAACCAGAGGCTTTGATTATTGGGGCCAGGGCACCCTGGTC<br>ACCGTTTCTTCA |
| 266 | AGCTACAGCATGAAC |
| 267 | GGCGTGTCCTGGGCCGGCAGCAGAACCCACTATGCCGACAGCGTGAAGGGC |

ANTIBODY SEQUENCES

| SEQ ID | Sequence |
|---|---|
| 268 | GCTGCCGCCGGAACCAGAGGCTTTGATTAT |
| 269 | CAGTCTGTTCTGACACAGCCTCCTAGCGCCTCTGGCACACCTGGACAGAGAGTGACCA<br>TCAGCTGTAGCGGCAGCAGCTCCAATATCGGCAGCCACATCGTGAACTGGTATCAGCA<br>GCTGCCTGGCACAGCCCCTAAACTGCTGATCTACGGCAACACCAACAGACCCAGCGG<br>CGTGCCCGATAGATTTTCCGGCTCTAAGAGCGGCACAAGCGCCAGCCTGGCTATCTCT<br>GGACTGAGATCTGAGGACGAGGCCGACTACTACTGCAGCAGCTACACCAGCATCAGC<br>ACCCTGGTTTTTGGCGGAGGCACCAAGCTGACAGTGCTA |
| 270 | AGCGGCAGCAGCTCCAATATCGGCAGCCACATCGTGAAC |
| 271 | GGCAACACCAACAGACCCAGC |
| 272 | AGCAGCTACACCAGCATCAGCACCCTGGTT |
| 273 | EVQLLESGGGLVQPGGSLRLSCAASGFTFSSYSMNWVRQAPGKGLEWVSGVSWAGSRTH<br>YADSVKGRFTISRDNSKNTLYLQMNSLRAEDTAVYYCARAAAGTRGFDYWGQGTLVTV<br>SSASTKGPSVFPLAPSSKSTSGGTAALGCLVKDYFPEPVTVSWNSGALTSGVHTFPAVLQS<br>SGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYN<br>STYRVVSVLTVLHQDWLNGKEYKCKVSNKALPAPIEKTISKAKGQPREPQVYTLPPSRDE<br>LTKNQVSLTCLVKGFYPSDIAVEWESNGQPENNYKTTPPVLDSDGSFFLYSKLTVDKSRW<br>QQGNVFSCSVMHEALHNHYTQKSLSLSPG |
| 274 | QSVLTQPPSASGTPGQRVTISCSGSSSNIGSHIVNWYQQLPGTAPKLLIYGNTNRPSGVPDR<br>FSGSKSGTSASLAISGLRSEDEADYYCSSYTSISTLVFGGGTKLTVLGQP-<br>KAAPSVTLFPPSS<br>EELQANKATLVCLISDFYPGAVTVAWKADSSPVKAGVETTTPSKQSNNKYAASSYLSLTP<br>EQWKSHRSYSCQVTHEGSTVEKTVAPTECS |
| 275 | EVQLLESGGGLVQPGGSLRLSCAASGFTFRSYAMHWVRQAPGKGLEWVSLISWDGGSTY<br>YADSVKGRFTISRDNSKNTLYLQMNSLRAEDTAVYYCARGGIGRRPGLEYWGQGTLVTV<br>SS |
| 276 | SYAMH |
| 277 | LISWDGGSTYYADSVKG |
| 278 | GGIGRRPGLEY |
| 279 | QSVLTQPPSASGTPGQRVTISCSGSSSNIGNNYVSWYQQLPGTAPKLLIYGNSNRPSGVPDR<br>FSGSKSGTSASLAISGLRSEDEADYYCQTWGTGIRVFGGGTKLTVL |
| 280 | SGSSSNIGNNYVS |
| 281 | GNSNRPS |
| 282 | QTWGTGIRV |
| 283 | GAGGTGCAGCTGTTGGAGTCTGGGGGAGGCTTGGTACAGCCTGGGGGGTCCCTGAGA<br>CTCTCCTGTGCAGCCTCTGGATTCACCTTCAGGAGCTATGCTATGCACTGGGTCCGCCA<br>GGCTCCAGGCAAGGGGCTGGAGTGGGTCTCTCTTATTAGTTGGGATGGTGGTAGCACC<br>TACTATGCAGACTCTGTGAAGGGTCGATTCACCATCTCCAGAGACAATTCCAAGAACA<br>CGCTGTATCTGCAAATGAACAGCCTGAGAGCCGAGGACACTGCCGTGTATTACTGTGC<br>GAGAGGGGGTATAGGGCGTCGTCCTGGGCTTGAGTACTGGGGCCAAGGTACCCTGGT<br>CACCGTGAGTTCA |
| 284 | AGCTATGCTATGCAC |
| 285 | CTTATTAGTTGGGATGGTGGTAGCACCTACTATGCAGACTCTGTGAAGGGT |
| 286 | GGGGGTATAGGGCGTCGTCCTGGGCTTGAGTAC |
| 287 | CAGTCTGTGCTGACTCAGCCACCCTCAGCGTCTGGGACCCCCGGGCAGAGGGTCACCA<br>TCTCCTGCTCTGGAAGCAGCTCCAACATTGGAAATAATTATGTTTCCTGGTATCAGCA<br>GCTCCCAGGAACGGCCCCCAAACTCCTCATCTATGGTAACAGCAATCGGCCCTCAGGG<br>GTCCCTGACCGATTCTCTGGCTCCAAGTCTGGCACCTCAGCCTCCCGGCCATCAGTGG<br>GCTCCGGTCCGAGGATGAGGCTGATTATTACTGTCAGACCTGGGGCACTGGCATTCGG<br>GTGTTCGGCGGAGGAACCAAGCTGACGGTCCTA |
| 288 | TCTGGAAGCAGCTCCAACATTGGAAATAATTATGTTTCC |
| 289 | GGTAACAGCAATCGGCCCTCA |
| 290 | CAGACCTGGGGCACTGGCATTCGGGTG |

ANTIBODY SEQUENCES

| SEQ ID | Sequence |
|---|---|
| 291 | EVQLLESGGGLVQPGGSLRLSCAASGFTFRSYAMHWVRQAPGKGLEWVSLISWDGGSTY YADSVKGRFTISRDNSKNTLYLQMNSLRAEDTAVYYCARGGIGRRPGLEYWGQGTLVTV SSASTKGPSVFPLAPSSKSTSGGTAALGCLVKDYFPEPVTVSWNSGALTSGVHTFPAVLQS SGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYN STYRVVSVLTVLHQDWLNGKEYKCKVSNKALPAPIEKTISKAKGQPREPQVYTLPPSRDE LTKNQVSLTCLVKGFYPSDIAVEWESNGQPENNYKTTPPVLDSDGSFFLYSKLTVDKSRW QQGNVFSCSVMHEALHNHYTQKSLSLSPG |
| 292 | QSVLTQPPSASGTPGQRVTISCSGSSSNIGNNYVSWYQQLPGTAPKLLIYGNSNRPSGVPDR FSGSKSGTSASLAISGLRSEDEADYYCQTWGTGIRVFGGGTKLTVLGQPKAAPSVTLFPPSS EELQANKATLVCLISDFYPGAVTVAWKADSSPVKAGVETTTPSKQSNNKYAASSYLSLTP EQWKSHRSYSCQVTHEGSTVEKTVAPTECS |
| 293 | EVQLLESGGGLVQPGGSLRLSCAASGFTFSSYAMSWVRQAPGKGLEWVGRIRSKANSYA TAYAASVKGRFTISRDNSKNTLYLQMNSLRAEDTAVYYCTRPLDSWGQGTLVTVSS |
| 294 | SYAMS |
| 295 | RIRSKANSYATAYAASVKG |
| 296 | PLDS |
| 297 | QSVLTQPPSASGTPGQRVTISCSGSSSNIGNNAVNWYQQLPGTAPKLLIYRNNQRSSGVPD RFSGSKSGTSASLAISGLRSEDEADYYCQSYDNSLSASVFGGGTKLTVL |
| 298 | SGSSSNIGNNAVN |
| 299 | RNNQRSS |
| 300 | QSYDNSLSASV |
| 301 | GAGGTGCAGCTGTTGGAGTCTGGGGGAGGCTTGGTACAGCCTGGGGGGTCCCTGAGA CTCTCCTGTGCAGCCTCTGGATTCACCTTTAGCAGCTATGCCATGAGCTGGGTCCGCCA GGCTCCAGGGAAGGGGCTGGAGTGGGTTGGCCGTATTAGAAGCAAAGCTAACAGTTA CGCGACAGCATATGCTGCGTCGGTGAAAGGCAGGTTCACCATCTCCAGAGACAATTCC AAGAACACGCTGTATCTGCAAATGAACAGCCTGAGAGCCGAGGACACTGCCGTGTAT TACTGTACGAGGCCCTTGGACTCCTGGGGCCAAGGTACCCTGGTCACCGTGAGTTCA |
| 302 | AGCTATGCCATGAGC |
| 303 | CGTATTAGAAGCAAAGCTAACAGTTACGCGACAGCATATGCTGCGTCGGTGAAAGGC |
| 304 | CCCTTGGACTCC |
| 305 | CAGTCTGTGCTGACTCAGCCACCCTCAGCGTCTGGGACCCCCGGGCAGAGGGTCACCA TCTCCTGTTCTGGAAGCAGCTCCAACATCGGAAATAATGCTGTAAACTGGTATCAGCA GCTCCCAGGAACGGCCCCCAAACTCCTCATCTATAGAAATAATCAGCGGTCCTCAGGG GTCCCTGACCGATTCTCTGGCTCCAAGTCTGGCACCTCAGCCTCCCTGGCCATCAGTGG GCTCCGGTCCGAGGATGAGGCTGATTATTACTGCCAGTCCTATGACAACAGCCTGAGT GCTTCGGTGTTCGGCGGAGGAACCAAGCTGACGGTCCTA |
| 306 | TCTGGAAGCAGCTCCAACATCGGAAATAATGCTGTAAAC |
| 307 | AGAAATAATCAGCGGTCCTCA |
| 308 | CAGTCCTATGACAACAGCCTGAGTGCTTCGGTG |
| 309 | EVQLLESGGGLVQPGGSLRLSCAASGFTFSSYAMSWVRQAPGKGLEWVGRIRSKANSYA TAYAASVKGRFTISRDNSKNTLYLQMNSLRAEDTAVYYCTRPLDSWGQGTLVTVSSAST KGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSRDELTKNQ VSLTCLVKGFYPSDIAVEWESNGQPENNYKTTPPVLDSDGSFFLYSKLTVDKSRWQQGNV FSCSVMHEALHNHYTQKSLSLSPG |
| 310 | QSVLTQPPSASGTPGQRVTISCSGSSSNIGNNAVNWYQQLPGTAPKLLIYRNNQRSSGVPD RFSGSKSGTSASLAISGLRSEDEADYYCQSYDNSLSASVFGGGTKLTVLGQPKAAPSVTLF PPSSEELQANKATLVCLISDFYPGAVTVAWKADSSPVKAGVETTTPSKQSNNKYAASSYL SLTPEQWKSHRSYSCQVTHEGSTVEKTVAPTECS |
| 311 | EVQLLESGGGLLQPGGSLRLSCAASGFTFSNAWMSWVRQAPGKGLEWVAVISYDGRNKY SADSVKGRFTISRDNSKNTLYLQMNSLRAEDTAVYYCARGLPYGYWGQGTLVTVSS |

ANTIBODY SEQUENCES

| SEQ ID | Sequence |
|---|---|
| 312 | NAWMS |
| 313 | VISYDGRNKYSADSVKG |
| 314 | GLPYGY |
| 315 | QSVLTQPPSASGTPGQRVTISCSGSSSNIGSNTVNWYQQLPGTAPKLLIYRNNQRPSGVPDR<br>FSGSKSGTSASLAISGLRSEDEADYYCAAWDDSLKALVFGGGTKLTVL |
| 316 | SGSSSNIGSNTVN |
| 317 | RNNQRPS |
| 318 | AAWDDSLKALV |
| 319 | GAGGTGCAGCTGTTGGAGTCTGGGGGAGGCTTGTTACAGCCTGGGGGGTCCCTGAGA<br>CTCTCCTGTGCAGCCTCTGGATTCACCTTCAGTAACGCCTGGATGAGCTGGGTCCGCC<br>AGGCTCCAGGGAAGGGGCTGGAGTGGGTGGCAGTTATATCATATGATGGAAGAAATA<br>AATACTCTGCAGACTCCGTGAAGGGCCGATTCACCATCTCCAGAGACAATTCCAAGAA<br>CACGCTGTATCTGCAAATGAACAGCCTGAGAGCCGAGGACACTGCCGTGTATTACTGT<br>GCGAGGGGCCTCCCTTATGGCTACTGGGGCCAAGGTACCCTGGTCACCGTGAGTTCA |
| 320 | AACGCCTGGATGAGC |
| 321 | GTTATATCATATGATGGAAGAAATAAATACTCTGCAGACTCCGTGAAGGGC |
| 322 | GGCCTCCCTTATGGCTAC |
| 323 | CAGTCTGTGCTGACTCAGCCACCCTCAGCGTCTGGGACCCCCGGGCAGAGGGTCACCA<br>TCTCTTGTTCTGGAAGCAGCTCCAACATCGGAAGTAATACTGTAAACTGGTATCAGCA<br>GCTCCCAGGAACGGCCCCCAAACTCCTCATCTATAGGAATAATCAGCGGCCCTCAGGG<br>GTCCCTGACCGATTCTCTGGCTCCAAGTCTGGCACCTCAGCCTCCCTGGCCATCAGTGG<br>GCTCCGGTCCGAGGATGAGGCTGATTATTACTGTGCTGCATGGGATGACAGTCTGAAG<br>GCTCTGGTATTCGGCGGAGGAACCAAGCTGACGGTCCTA |
| 324 | TCTGGAAGCAGCTCCAACATCGGAAGTAATACTGTAAAC |
| 325 | AGGAATAATCAGCGGCCCTCA |
| 326 | GCTGCATGGGATGACAGTCTGAAGGCTCTGGTA |
| 327 | EVQLLESGGGLLQPGGSLRLSCAASGFTFSNAWMSWVRQAPGKGLEWVAVISYDGRNKY<br>SADSVKGRFTISRDNSKNTLYLQMNSLRAEDTAVYYCARGLPYGYWGQGTLVTVSSAST<br>KGPSVFPLAPSSKSTSGGTAALGCLVKDYFPEPVTVSWNSGALTSGVHTFPAVLQSSGLYS<br>LSSVVTVPSSSLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSRDELTKNQ<br>VSLTCLVKGFYPSDIAVEWESNGQPENNYKTTPPVLDSDGSFFLYSKLTVDKSRWQQGNV<br>FSCSVMHEALHNHYTQKSLSLSPG |
| 328 | QSVLTQPPSASGTPGQRVTISCSGSSSNIGSNTVNWYQQLPGTAPKLLIYRNNQRPSGVPDR<br>FSGSKSGTSASLAISGLRSEDEADYYCAAWDDSLKALVFGGGTKLTVLGQPKAAPSVTLF<br>PPSSEELQANKATLVCLISDFYPGAVTVAWKADSSPVKAGVETTTPSKQSNNKYAASSYL<br>SLTPEQWKSHRSYSCQVTHEGSTVEKTVAPTECS<br>EVQLLESGGGLVQPGGSLRLSCAASGFTFSNAWMSWVRQAPGKGLEWVSGINWNGGST |
| 329 | GYADSVKGRFTISRDNSKNTLYLQMNSLRAEDTAVYYCVRTYSGHYGPYFDNWGQGTL<br>VTVSS |
| 330 | NAWMS |
| 331 | GINWNGGSTGYADSVKG |
| 332 | TYSGHYGPYFDN |
| 333 | QSVLTQPPSASGTPGQRVTISCSGSSSNIGSHTVNWYQQLPGTAPKLLIYRNNQRPSGVPDR<br>FSGSKSGTSASLAISGLRSEDEADYYCAAWDDSLNGWVFGGGTKLTVL |
| 334 | SGSSSNIGSHTVN |
| 335 | RNNQRPS |
| 336 | AAWDDSLNGWV |

ANTIBODY SEQUENCES

| SEQ ID | Sequence |
|---|---|
| 337 | GAGGTGCAGCTGTTGGAGTCTGGGGGAGGCTTGGTACAGCCTGGGGGGTCCCTGAGA<br>CTCTCCTGTGCAGCCTCTGGATTCACCTTCAGTAACGCCTGGATGAGCTGGGTCCGCC<br>AGGCTCCAGGGAAGGGGCTGGAGTGGGTCTCTGGTATTAATTGGAATGGTGGTAGCA<br>CAGGTTATGCAGACTCTGTGAAGGGCCGATTCACCATCTCCAGAGACAATTCCAAGAA<br>CACGCTGTATCTGCAAATGAACAGCCTGAGAGCCGAGGACACTGCCGTGTATTACTGT<br>GTTAGGACGTATAGTGGGCACTACGGACCCTACTTTGACAACTGGGGCCAAGGTACCC<br>TGGTCACCGTGAGTTCA |
| 338 | AACGCCTGGATGAGC |
| 339 | GGTATTAATTGGAATGGTGGTAGCACAGGTTATGCAGACTCTGTGAAGGGC |
| 340 | ACGTATAGTGGGCACTACGGACCCTACTTTGACAAC |
| 341 | CAGTCTGTGCTGACTCAGCCACCCTCAGCGTCTGGGACCCCCGGGCAGAGGGTCACCA<br>TCTCTTGTTCTGGAAGCAGCTCCAACATCGGAAGTCATACTGTAAACTGGTATCAGCA<br>GCTCCCAGGAACGGCCCCCAAACTCCTCATCTATAGGAATAATCAGCGGCCCTCAGGG<br>GTCCCTGACCGATTCTCTGGCTCCAAGTCTGGCACCTCAGCCTCCCTGGCCATCAGTGG<br>GCTCCGGTCCGAGGATGAGGCTGATTATTACTGTGCAGCATGGGATGACAGCCTGAAT<br>GGTTGGGTGTTCGGCGGAGGAACCAAGCTGACGGTCCTA |
| 342 | TCTGGAAGCAGCTCCAACATCGGAAGTCATACTGTAAAC |
| 343 | AGGAATAATCAGCGGCCCTCA |
| 344 | GCAGCATGGGATGACAGCCTGAATGGTTGGGTG |
| 345 | EVQLLESGGGLVQPGGSLRLSCAASGFTFSNAWMSWVRQAPGKGLEWVSGINWNGGST<br>GYADSVKGRFTISRDNSKNTLYLQMNSLRAEDTAVYYCVRTYSGHYGPYFDNWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 346 | QSVLTQPPSASGTPGQRVTISCSGSSSNIGSHTVNWYQQLPGTAPKLLIYRNNQRPSGVPDR<br>FSGSKSGTSASLAISGLRSEDEADYYCAAWDDSLNGWVFGGGTKLTVLGQPKAAPSVTLF<br>PPSSEELQANKATLVCLISDFYPGAVTVAWKADSSPVKAGVETTTPSKQSNNKYAASSYL<br>SLTPEQWKSHRSYSCQVTHEGSTVEKTVAPTECS |
| 347 | EVQLLESGGGLVQPGGSLRLSCAASGFTFVTYWMTWVRQAPGKGLEWVSGVSWNGSRT<br>HYVDSVKRRFTISRDNSKNTLYLQMNSLRAEDTAVYYCARYSGYPDYYGMDVWGQGTL<br>VTVSS |
| 348 | TYWMT |
| 349 | GVSWNGSRTHYVDSVKR |
| 350 | YSGYPDYYGMDV |
| 351 | QSVLTQPPSASGTPGQRVTISCSGSWSNIGNDNVYWYQQLPGTAPKLLIYRNNQRPSGVPD<br>RFSGSKSGTSASLAISGLRSEDEADYYCQSYDRSLSGSVFGGGTKLTVL |
| 352 | SGSWSNIGNDNVY |
| 353 | RNNQRPS |
| 354 | QSYDRSLSGSV |
| 355 | GAGGTGCAACTGTTGGAGTCTGGGGGAGGCTTGGTACAGCCTGGGGGGTCCCTGAGA<br>CTCTCCTGTGCAGCCTCTGGATTCACCTTTGTTACATATTGGATGACCTGGGTCCGCCA<br>GGCTCCAGGGAAGGGGCTGGAGTGGGTATCGGGTGTTAGTTGGAATGGCAGTAGGAC<br>GCACTATGTGGACTCCGTGAAGCGCCGATTCACCATCTCCAGAGACAATTCCAAGAAC<br>ACGCTGTATCTGCAAATGAACAGCCTGAGAGCCGAGGACACTGCCGTGTATTACTGTG<br>CGAGATATAGTGGCTACCCTGACTACTACGGTATGGACGTCTGGGGCCAAGGTACCCT<br>GGTCACCGTGAGTTCA |
| 356 | ACATATTGGATGACC |
| 357 | GGTGTTAGTTGGAATGGCAGTAGGACGCACTATGTGGACTCCGTGAAGCGC |
| 358 | TATAGTGGCTACCCTGACTACTACGGTATGGACGTC |

| ANTIBODY SEQUENCES |
|---|
| SEQ ID Sequence |
| 359 CAGTCTGTGCTGACTCAGCCACCCTCAGCGTCTGGGACCCCCGGGCAGAGGGTCACCA<br>TCTCTTGTTCTGGAAGCTGGTCCAACATCGGAAATGATAATGTATACTGGTATCAGCA<br>GCTCCCAGGAACGGCCCCCAAACTCCTCATCTATAGGAATAATCAGCGGCCCTCAGGG<br>GTCCCTGACCGATTCTCTGGCTCCAAGTCTGGCACCTCAGCCTCCCTGGCCATCAGTGG<br>GCTCCGGTCCGAGGATGAGGCTGATTATTACTGCCAGTCTTATGACAGGAGCCTGAGT<br>GGTTCGGTGTTCGGCGGAGGAACCAAGCTGACGGTCCTA |
| 360 TCTGGAAGCTGGTCCAACATCGGAAATGATAATGTATAC |
| 361 AGGAATAATCAGCGGCCCTCA |
| 362 CAGTCTTATGACAGGAGCCTGAGTGGTTCGGTG |
| 363 EVQLLESGGGLVQPGGSLRLSCAASGFTFVTYWMTWVRQAPGKGLEWVSGVSWNGSRT<br>HYVDSVKRRFTISRDNSKNTLYLQMNSLRAEDTAVYYCARYSGYPDYYGMDVWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 364 QSVLTQPPSASGTPGQRVTISCSGSWSNIGNDNVYWYQQLPGTAPKLLIYRNNQRPSGVPD<br>RFSGSKSGTSASLAISGLRSEDEADYYCQSYDRSLSGSVFGGGTKLTVLGQPKAAPSVTLF<br>PPSSEELQANKATLVCLISDFYPGAVTVAWKADSSPVKAGVETTTPSKQSNNKYAASSYL<br>SLTPEQWKSHRSYSCQVTHEGSTVEKTVAPTECS<br>EVQLLESGGGLVQPGGSLRLSCAASGFTFSSYGMHWVRQAPGKGLEWVSGVSWNGSRTR |
| 365 YADSVKGRFTISRDNSKNTLYLQMNSLRAEDTAVYYCTRGSYNSGWYAVSWGQGTLVT<br>VSS |
| 366 SYGMH |
| 367 GVSWNGSRTRYADSVKG |
| 368 GSYNSGWYAVS |
| 369 QSVLTQPPSASGTPGQRVTISCSGSSSNIGSYPVNWYQQLPGTAPKLLIYRNNQRPSGVPDR<br>FSGSKSGTSASLAISGLRSEDEADYYCSSYSVTDNLIFGGGTKLTVL |
| 370 SGSSSNIGSYPVN |
| 371 RNNQRPS |
| 372 SSYSVTDNLI |
| 373 GAGGTGCAGCTGTTGGAGTCTGGGGGAGGCTTGGTACAGCCTGGGGGGTCCCTGAGA<br>CTCTCCTGTGCAGCCTCTGGATTCACCTTCAGTAGCTATGGCATGCACTGGGTCCGCCA<br>GGCTCCAGGCAAGGGGCTGGAGTGGGTATCGGGTGTTAGTTGGAATGGCAGTAGGAC<br>GCGCTATGCGGACTCTGTGAAGGGCCGATTCACCATCTCCAGAGACAATTCCAAGAAC<br>ACGCTGTATCTGCAAATGAACAGCCTGAGAGCCGAGGACACTGCCGTGTATTACTGTA<br>CTAGAGGGTCATATAATAGTGGCTGGTACGCGGTCTCCTGGGGCCAAGGTACCCTGGT<br>CACCGTGAGTTCA |
| 374 AGCTATGGCATGCAC |
| 375 GGTGTTAGTTGGAATGGCAGTAGGACGCGCTATGCGGACTCTGTGAAGGGC |
| 376 GGGTCATATAATAGTGGCTGGTACGCGGTCTCC |
| 377 CAGTCTGTGCTGACTCAGCCACCCTCAGCGTCTGGGACCCCTGGGCAGAGGGTCACCA<br>TCTCTTGTTCTGGAAGCAGTTCCAACATCGGGAGTTATCCTGTAAACTGGTATCAGCA<br>GCTCCCAGGAACGGCCCCCAAACTCCTCATCTATAGGAATAATCAGCGGCCCTCAGGG<br>GTCCCTGACCGATTCTCTGGCTCCAAGTCTGGCACCTCAGCCTCCCTGGCCATCAGTGG<br>GCTCCGGTCCGAGGATGAGGCTGATTATTACTGCAGCTCATATTCTGTCACCGACAAT<br>TTGATATTCGGCGGAGGAACCAAGCTGACGGTCCTA |
| 378 TCTGGAAGCAGTTCCAACATCGGGAGTTATCCTGTAAAC |
| 379 AGGAATAATCAGCGGCCCTCA |
| 380 AGCTCATATTCTGTCACCGACAATTTGATA |

ANTIBODY SEQUENCES

| SEQ ID | Sequence |
|---|---|
| 381 | EVQLLESGGGLVQPGGSLRLSCAASGFTFSSYGMHWVRQAPGKGLEWVSGVSWNGSRTR YADSVKGRFTISRDNSKNTLYLQMNSLRAEDTAVYYCTRGSYNSGWYAVSWGQGTLVT VSSASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPREPQVYTLPPSRD ELTKNQVSLTCLVKGFYPSDIAVEWESNGQPENNYKTTPPVLDSDGSFFLYSKLTVDKSR WQQGNVFSCSVMHEALHNHYTQKSLSLSPG |
| 382 | QSVLTQPPSASGTPGQRVTISCSGSSSNIGSYPVNWYQQLPGTAPKLLIYRNNQRPSGVPDR FSGSKSGTSASLAISGLRSEDEADYYCSSYSVTDNLIFGGGTKLTVLGQPKAAPSVTLFPPS SEELQANKATLVCLISDFYPGAVTVAWKADSSPVKAGVETTTPSKQSNNKYAASSYLSLT PEQWKSHRSYSCQVTHEGSTVEKTVAPTECS EVQLLESGGGLVQPGGSLRLSCAASGFTFSNYRMTWVRQAPGKGLEWVSGINWNGGSTG |
| 383 | YADSVKGRFTISRDNSKNTLYLQMNSLRAEDTAVYYCARGRFDTRGFYGFDYWGQGTLV TVSS |
| 384 | NYRMT |
| 385 | GINWNGGSTGYADSVKG |
| 386 | GRFDTRGFYGFDY |
| 387 | QSVLTQPPSASGTPGQRVTISCTGSSSNIGAGYDVHWYQQLPGTAPKLLIYSHNQRPSGVP DRFSGSKSGTSASLAISGLRSEDEADYYCSAWDSSLSAWVFGGGTKLTVL |
| 388 | TGSSSNIGAGYDVH |
| 389 | SHNQRPS |
| 390 | SAWDSSLSAWV |
| 391 | GAGGTGCAGCTGTTGGAGTCTGGGGGAGGCTTGGTACAGCCTGGGGGGTCCCTGAGA CTCTCCTGTGCAGCCTCTGGATTCACCTTCAGTAATTATAGGATGACCTGGGTCCGCCA GGCTCCAGGGAAGGGGCTGGAGTGGGTCTCTGGTATTAATTGGAATGGTGGTAGCAC AGGTTATGCAGACTCTGTGAAGGGCCGATTCACCATCTCCAGAGACAATTCCAAGAAC ACGCTGTATCTGCAAATGAACAGCCTGAGAGCCGAGGACACTGCCGTGTATTACTGTG CCAGAGGGCGCTTTGATACTAGGGGTTTTTACGGCTTTGACTACTGGGGCCAAGGTAC CCTGGTCACCGTGAGTTCA |
| 392 | AATTATAGGATGACC |
| 393 | GGTATTAATTGGAATGGTGGTAGCACAGGTTATGCAGACTCTGTGAAGGGC |
| 394 | GGGCGCTTTGATACTAGGGGTTTTTACGGCTTTGACTAC |
| 395 | CAGTCTGTGCTGACTCAGCCACCCTCAGCGTCTGGGACCCCCGGGCAGAGGGTCACCA TCTCCTGCACTGGGAGCAGCTCCAACATCGGGGCAGGTTATGATGTACACTGGTATCA GCAGCTCCCAGGAACGGCCCCCAAACTCCTCATCTATAGTCATAATCAGCGGCCCTCA GGGGTCCCTGACCGATTCTCTGGCTCCAAGTCTGGCACCTCAGCCTCCCTGGCCATCA GTGGGCTCCGGTCCGAGGATGAGGCTGATTATTACTGCTCAGCATGGGACAGCAGCCT CAGTGCTTGGGTGTTCGGCGGAGGAACCAAGCTGACGGTCCTA |
| 396 | ACTGGGAGCAGCTCCAACATCGGGGCAGGTTATGATGTACAC |
| 397 | AGTCATAATCAGCGGCCCTCA |
| 398 | TCAGCATGGGACAGCAGCCTCAGTGCTTGGGTG |
| 399 | EVQLLESGGGLVQPGGSLRLSCAASGFTFSNYRMTWVRQAPGKGLEWVSGINWNGGSTG YADSVKGRFTISRDNSKNTLYLQMNSLRAEDTAVYYCARGRFDTRGFYGFDYWGQGTLV TVSSASTKGPSVFPLAPSSKSTSGGTAALGCLVKDYFPEPVTVSWNSGALTSGVHTFPAVL QSSGLYSLSSVVTVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSR DELTKNQVSLTCLVKGFYPSDIAVEWESNGQPENNYKTTPPVLDSDGSFFLYSKLTVDKSR WQQGNVFSCSVMHEALHNHYTQKSLSLSPG |
| 400 | QSVLTQPPSASGTPGQRVTISCTGSSSNIGAGYDVHWYQQLPGTAPKLLIYSHNQRPSGVP DRFSGSKSGTSASLAISGLRSEDEADYYCSAWDSSLSAWVFGGGTKLTVLGQPKAAPSVT LFPPSSEELQANKATLVCLISDFYPGAVTVAWKADSSPVKAGVETTTPSKQSNNKYAASS YLSLTPEQWKSHRSYSCQVTHEGSTVEKTVAPTECS |

ANTIBODY SEQUENCES

| SEQ ID | Sequence |
|---|---|
| 401 | EVQLLESGGGLVQPGGSLRLSCAASGFTFSSYAMSWVRQAPGKGLEWVSGIRWNSGSKG YAGSVKGRFTISRDNSKNTLYLQMNSLRAEDTAVYYCVRSGNYYVGYHGMDVWGQGTL VTVSS |
| 402 | SYAMS |
| 403 | GIRWNSGSKGYAGSVKG |
| 404 | SGNYYVGYHGMDV |
| 405 | QSVLTQPPSASGTPGQRVTISCSGGNSNIGTYFVSWYQQLPGTAPKLLIYTNNQRPSGVPD RFSGSKSGTSASLAISGLRSEDEADYYCETWDSNTRVFGGGTKLTVL |
| 406 | SGGNSNIGTYFVS |
| 407 | TNNQRPS |
| 408 | ETWDSNTRV |
| 409 | GAAGTTCAGCTGCTGGAATCTGGCGGCGGACTGGTTCAACCTGGCGGATCTCTGAGAC TGAGCTGTGCCGCCAGCGGCTTCACCTTTAGCAGCTACGCCATGAGCTGGGTCCGACA GGCTCCTGGCAAAGGCCTTGAATGGGTGTCCGGCATCAGATGGAACAGCGGCTCTAA GGGCTATGCCGGCTCTGTGAAGGGCAGATTCACCATCAGCCGGGACAACAGCAAGAA CACCCTGTACCTGCAGATGAACAGCCTGAGAGCCGAGGACACCGCCGTGTACTACTGT GTGCGGAGCGGCAATTACTACGTGGGCTACCACGGCATGGATGTGTGGGGACAGGGA ACCCTGGTTACCGTTTCTTCA |
| 410 | AGCTACGCCATGAGC |
| 411 | GGCATCAGATGGAACAGCGGCTCTAAGGGCTATGCCGGCTCTGTGAAGGGC |
| 412 | AGCGGCAATTACTACGTGGGCTACCACGGCATGGATGTG |
| 413 | CAGTCTGTTCTGACACAGCCTCCTAGCGCCTCTGGCACACCTGGACAGAGAGTGACCA TCAGCTGTAGCGGCGGCAACAGCAACATCGGCACCTACTTCGTGTCCTGGTATCAGCA GCTGCCTGGCACAGCCCCTAAACTGCTGATCTACACCAACAACCAGCGGCCTAGCGGC GTGCCCGATAGATTTTCTGGCAGCAAGAGCGGCACAAGCGCCAGCCTGGCTATCTCTG GACTGAGATCTGAGGACGAGGCCGACTACTACTGCGAGACATGGGACAGCAACACCA GAGTGTTTGGCGGAGGCACCAAGCTGACAGTGCTA |
| 414 | AGCGGCGGCAACAGCAACATCGGCACCTACTTCGTGTCC |
| 415 | ACCAACAACCAGCGGCCTAGC |
| 416 | GAGACATGGGACAGCAACACCAGAGTG |
| 417 | EVQLLESGGGLVQPGGSLRLSCAASGFTFSSYAMSWVRQAPGKGLEWVSGIRWNSGSKG YAGSVKGRFTISRDNSKNTLYLQMNSLRAEDTAVYYCVRSGNYYVGYHGMDVWGQGTL VTVSSASTKGPSVFPLAPSSKSTSGGTAALGCLVKDYFPEPVTVSWNSGALTSGVHTFPAV LQSSGLYSLSSVVTVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSR DELTKNQVSLTCLVKGFYPSDIAVEWESNGQPENNYKTTPPVLDSDGSFFLYSKLTVDKSR WQQGNVFSCSVMHEALHNHYTQKSLSLSPG |
| 418 | QSVLTQPPSASGTPGQRVTISCSGGNSNIGTYFVSWYQQLPGTAPKLLIYTNNQRPSGVPD RFSGSKSGTSASLAISGLRSEDEADYYCETWDSNTRVFGGGTKLTVLGQPKAAPSVTLFPP SSEELQANKATLVCLISDFYPGAVTVAWKADSSPVKAGVETTTPSKQSNNKYAASSYLSL TPEQWKSHRSYSCQVTHEGSTVEKTVAPTECS |
| 419 | EVQLLESGGGLVQPGGSLRLSCAASGFTFSHYGMHWVRQAPGKGLEWVSGINWNGGST GYADSVKGRFTISRDNSKNTLYLQMNSLRAEDTAVYYCARGHHSGYDGRFFDYWGQGT LVTVSS |
| 420 | HYGMH |
| 421 | GINWNGGSTGYADSVKG |
| 422 | GHHSGYDGRFFDY |
| 423 | QSVLTQPPSASGTPGQRVTISCTGSSSNIGAGYNVHWYQQLPGTAPKLLIYTNNRRPSGVP DRFSGSKSGTSASLAISGLRSEDEADYYCAAWDASLSGWVFGGGTKLTVL |
| 424 | TGSSSNIGAGYNVH |

ANTIBODY SEQUENCES

| SEQ ID | Sequence |
|---|---|
| 425 | TNNRRPS |
| 426 | AAWDASLSGWV |
| 427 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 428 | CACTATGGCATGCAC |
| 429 | GGCATCAACTGGAATGGCGGCTCTACAGGCTACGCCGACTCTGTGAAGGGC |
| 430 | GGCCACCACAGCGGCTACGACGGCAGATTCTTTGACTAT |
| 431 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCTGGGATGCTTCTC<br>TGAGCGGATGGGTTTTCGGCGGAGGCACCAAACTGACAGTGCTA |
| 432 | ACCGGCAGCAGCTCCAATATCGGAGCCGGCTACAACGTGCAC |
| 433 | ACCAACAACAGACGGCCCAGC |
| 434 | GCCGCCTGGGATGCTTCTCTGAGCGGATGGGTT |
| 435 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSSASTKGPSVFPLAPSSKSTSGGTAALGCLVKDYFPEPVTVSWNSGALTSGVHTFPA<br>VLQSSGLYSLSSVVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDGVEVHNAKTKPRE<br>EQYNSTYRVVSVLTVLHQDWLNGKEYKCKVSNKALPAPIEKTISKAKGQPREPQVYTLPP<br>SRDELTKNQVSLTCLVKGFYPSDIAVEWESNGQPENNYKTTPPVLDSDGSFFLYSKLTVDK<br>SRWQQGNVFSCSVMHEALHNHYTQKSLSLSPG |
| 436 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 437 | EVQLLESGGGLVQPGGSLRLSCAASGFTFSNAWMSWVRQAPGKGLEWVSGINWNGGST<br>GYADSVKGRFTISRDNSKNTLYLQMNSLRAEDTAVYYCARTYTGNYGPYFDYWGQGTL<br>VTVSS |
| 438 | NAWMS |
| 439 | GINWNGGSTGYADSVKG |
| 440 | TYTGNYGPYFDY |
| 441 | QSVLTQPPSASGTPGQRVTISCTGSSSNIGAGYDVHWYQQLPGTAPKLLIYKNNQRPSGVP<br>DRFSGSKSGTSASLAISGLRSEDEADYYCAAWDDSLRGWVFGGGTKLTVL |
| 442 | TGSSSNIGAGYDVH |
| 443 | KNNQRPS |
| 444 | AAWDDSLRGWV |
| 445 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAATGCCTGGATGAGCTGGGTCCGACA<br>GGCCCCTGGAAAAGGCCTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTACTGT<br>GCCAGAACCTACACCGGCAACTACGGCCCCTACTTCGATTATTGGGGCCAGGGCACAC<br>TGGTCACCGTTTCTTCA |

ANTIBODY SEQUENCES

| SEQ ID | Sequence |
|---|---|
| 446 | AATGCCTGGATGAGC |
| 447 | GGCATCAACTGGAATGGCGGCTCTACAGGCTACGCCGACTCTGTGAAGGGC |
| 448 | ACCTACACCGGCAACTACGGCCCCTACTTCGATTAT |
| 449 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTATGACGTGCACTGGTATCA<br>GCAGCTGCCTGGCACAGCCCCTAAACTGCTGATCTACAAGAACAACCAGCGGCCTAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGATTCTC<br>TGAGAGGCTGGGTTTTCGGCGGAGGCACCAAACTGACAGTGCTA |
| 450 | ACCGGCAGCAGCTCCAATATCGGAGCCGGCTATGACGTGCAC |
| 451 | AAGAACAACCAGCGGCCTAGC |
| 452 | GCCGCCTGGGATGATTCTCTGAGAGGCTGGGTT |
| 453 | EVQLLESGGGLVQPGGSLRLSCAASGFTFSNAWMSWVRQAPGKGLEWVSGINWNGGST<br>GYADSVKGRFTISRDNSKNTLYLQMNSLRAEDTAVYYCARTYTGNYGPYFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 454 | QSVLTQPPSASGTPGQRVTISCTGSSSNIGAGYDVHWYQQLPGTAPKLLIYKNNQRPSGVP<br>DRFSGSKSGTSASLAISGLRSEDEADYYCAAWDDSLRGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 455 | EVQLLESGGGLVQPGGSLRLSCAASGFTFSSAWMSWVRQAPGKGLEWVSGISWSGGSTG<br>YADSVKGRFTISRDNSKNTLYLQMNSLRAEDTAVYYCARTYSGHYGPYFDYWGQGTLVT<br>VSS |
| 456 | SAWMS |
| 457 | GISWSGGSTGYADSVKG |
| 458 | TYSGHYGPYFDY |
| 459 | QSVLTQPPSASGTPGQRVTISCSGSSSNIGSHTVNWYQQLPGTAPKLLIYRNNQRPSGVPDR<br>FSGSKSGTSASLAISGLRSEDEADYYCAAWDDSLNGWVFGGGTKLTVL |
| 460 | SGSSSNIGSHTVN |
| 461 | RNNQRPS |
| 462 | AAWDDSLNGWV |
| 463 | GAAGTTCAGCTGCTGGAATCTGGCGGCGGACTGGTTCAACCTGGCGGATCTCTGAGAC<br>TGAGCTGTGCCGCCAGCGGCTTCACATTTTCTAGCGCCTGGATGAGCTGGGTCCGACA<br>GGCTCCTGGAAAAGGCCTGGAATGGGTGTCCGGCATCTCTTGGAGCGGCGGCTCTACA<br>GGCTATGCCGATTCTGTGAAGGGCAGATTCACCATCAGCCGGGACAACAGCAAGAAC<br>ACCCTGTACCTGCAGATGAACTCCCTGAGAGCCGAGGACACCGCCGTGTACTACTGTG<br>CCAGAACATACAGCGGCCACTACGGCCCCTACTTCGATTATTGGGGCCAGGGCACACT<br>GGTCACCGTTTCTTCA |
| 464 | AGCGCCTGGATGAGC |
| 465 | GGCATCTCTTGGAGCGGCGGCTCTACAGGCTATGCCGATTCTGTGAAGGGC |
| 466 | ACATACAGCGGCCACTACGGCCCCTACTTCGATTAT |
| 467 | CAGTCTGTGCTGACTCAGCCACCCTCAGCGTCTGGGACCCCCGGGCAGAGGGTCACCA<br>TCTCTTGTTCTGGAAGCAGCTCCAACATCGGAAGTCATACTGTAAACTGGTATCAGCA<br>GCTCCCAGGAACGGCCCCAAACTCCTCATCTATAGGAATAATCAGCGGCCCTCAGGG<br>GTCCCTGACCGATTCTCTGGCTCCAAGTCTGGCACCTCAGCCTCCCTGGCCATCAGTGG<br>GCTCCGGTCCGAGGATGAGGCTGATTATTACTGTGCAGCATGGGATGACAGCCTGAAT<br>GGTTGGGTGTTCGGCGGAGGAACCAAGCTGACGGTCCTA |
| 468 | TCTGGAAGCAGCTCCAACATCGGAAGTCATACTGTAAAC |

ANTIBODY SEQUENCES

| SEQ ID | Sequence |
|---|---|
| 469 | AGGAATAATCAGCGGCCCTCA |
| 470 | GCAGCATGGGATGACAGCCTGAATGGTTGGGTG |
| 471 | EVQLLESGGGLVQPGGSLRLSCAASGFTFSSAWMSWVRQAPGKGLEWVSGISWSGGSTG<br>YADSVKGRFTISRDNSKNTLYLQMNSLRAEDTAVYYCARTYSGHYGPYFDYWGQGTLVT<br>VSSASTKGPSVFPLAPSSKSTSGGTAALGCLVKDYFPEPVTVSWNSGALTSGVHTFPAVLQ<br>SSGLYSLSSVVTVPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEVHNAKTKPREEQY<br>NSTYRVVSVLTVLHQDWLNGKEYKCKVSNKALPAPIEKTISKAKGQPREPQVYTLPPSRD<br>ELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 472 | QSVLTQPPSASGTPGQRVTISCSGSSSNIGSHTVNWYQQLPGTAPKLLIYRNNQRPSGVPDR<br>FSGSKSGTSASLAISGLRSEDEADYYCAAWDDSLNGWVFGGGTKLTVLGQPKAAPSVTLF<br>PPSSEELQANKATLVCLISDFYPGAVTVAWKADSSPVKAGVETTTPSKQSNNKYAASSYL<br>SLTPEQWKSHRSYSCQVTHEGSTVEKTVAPTECS |
| 473 | EVQLLESGGGLVQPGGSLRLSCAASGFTFSSYGMHWVRQAPGKGLEWVSAIKWGGGSHG<br>YADSVKGRFTISRDNSKNTLYLQMNSLRAEDTAVYYCARGHHSGKDGRFFDYWGQGTL<br>VTVSS |
| 474 | SYGMH |
| 475 | AIKWGGGSHGYADSVKG |
| 476 | GHHSGKDGRFFDY |
| 477 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 478 | TGSSSNIGAGYNVH |
| 479 | TNNRRPS |
| 480 | AAWDASLSGWV |
| 481 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATTAAGTGGGGCGGAGGCTCTCA<br>CGGCTATGCCGATTCTGTGAAGGGCAGATTCACCATCAGCCGGGACAACAGCAAGAA<br>CACCCTGTACCTGCAGATGAACAGCCTGAGAGCCGAGGACACCGCCGTGTACTATTGT<br>GCCAGAGGCCACCACTCTGGCAAGGACGGCAGATTCTTCGACTATTGGGGCCAGGGC<br>ACCCTGGTCACAGTTTCTTCA |
| 482 | AGCTATGGCATGCAC |
| 483 | GCCATTAAGTGGGGCGGAGGCTCTCACGGCTATGCCGATTCTGTGAAGGGC |
| 484 | GGCCACCACTCTGGCAAGGACGGCAGATTCTTCGACTAT |
| 485 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 486 | ACAGGCAGCAGCTCCAATATCGGAGCCGGCTACAACGTGCAC |
| 487 | ACCAACAACAGACGGCCCAGC |
| 488 | GCCGCCTGGGATGCTTCTCTGAGCGGATGGGTT |
| 489 | EVQLLESGGGLVQPGGSLRLSCAASGFTFSSYGMHWVRQAPGKGLEWVSAIKWGGGSHG<br>YADSVKGRFTISRDNSKNTLYLQMNSLRAEDTAVYYCARGHHSGKDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPGK |

-continued

ANTIBODY SEQUENCES

SEQ ID Sequence

490 QSVLTQPPSVSGAPGQRVTISCTGSSSNIGAGYNVHWYQQLPGTAPKLLIYTNNRRPSGVP
DRFSGSKSGTSASLAISGLRSEDEADYYCAAWDASLSGWVFGGGTKLTVLGQPKAAPSVT
LFPPSSEELQANKATLVCLISDFYPGAVTVAWKADSSPVKAGVETTTPSKQSNNKYAASS
YLSLTPEQWKSHRSYSCQVTHEGSTVEKTVAPTECS

491 EVQLLESGGGLVQPGGSLRLSCAASGFTFSSYGMHWVRQAPGKGLEWVSAIKWGGGSHG
YADSVKGRFTISRDNSKNTLYLQMNSLRAEDTAVYYCARGHHKGYDGRFFDYWGQGTL
VTVSS

492 SYGMH

493 AIKWGGGSHGYADSVKG

494 GHHKGYDGRFFDY

495 QSVLTQPPSVSGAPGQRVTISCTGSSSNIGAGYNVHWYQQLPGTAPKLLIYTNNRRPSGVP
DRFSGSKSGTSASLAISGLRSEDEADYYCAAWDASLSGWVFGGGTKLTVL

496 TGSSSNIGAGYNVH

497 TNNRRPS

498 AAWDASLSGWV

499 GAAGTTCAGCTGCTGGAATCTGGCGGCGGACTGGTTCAACCTGGCGGATCTCTGAGAC
TGAGCTGTGCCGCCAGCGGCTTCACCTTTAGCAGCTATGGCATGCACTGGGTCCGACA
GGCCCCTGGCAAAGGACTTGAATGGGTGTCCGCCATTAAGTGGGGCGGAGGCTCTCA
CGGCTATGCCGATTCTGTGAAGGGCAGATTCACCATCAGCCGGGACAACAGCAAGAA
CACCCTGTACCTGCAGATGAACAGCCTGAGAGCCGAGGACACCGCCGTGTACTATTGT
GCCAGAGGCCACCACAAGGGCTACGACGGCAGATTCTTCGACTATTGGGGCCAGGGC
ACCCTGGTCACAGTTTCTTCA

500 AGCTATGGCATGCAC

501 GCCATTAAGTGGGGCGGAGGCTCTCACGGCTATGCCGATTCTGTGAAGGGC

502 GGCCACCACAAGGGCTACGACGGCAGATTCTTCGACTAT

503 CAGTCTGTTCTGACACAGCCTCCATCTGTGTCTGGCGCCCCTGGACAGAGAGTGACCA
TCAGCTGTACAGGCAGCAGCTCCAATATCGGAGCCGGCTACAACGTGCACTGGTATCA
GCAGCTGCCTGGCACAGCCCCTAAACTGCTGATCTACACCAACAACAGACGGCCCAG
CGGCGTGCCCGATAGATTTTCTGGCAGCAAGAGCGGCACAAGCGCCAGCCTGGCTATC
TCTGGACTGAGATCTGAGGACGAGGCCGACTACTATTGCGCCGCCTGGGATGCTTCTC
TGAGCGGATGGGTTTTCGGCGGAGGCACCAAACTGACAGTGCTA

504 ACAGGCAGCAGCTCCAATATCGGAGCCGGCTACAACGTGCAC

505 ACCAACAACAGACGGCCCAGC

506 GCCGCCTGGGATGCTTCTCTGAGCGGATGGGTT

507 EVQLLESGGGLVQPGGSLRLSCAASGFTFSSYGMHWVRQAPGKGLEWVSAIKWGGGSHG
YADSVKGRFTISRDNSKNTLYLQMNSLRAEDTAVYYCARGHHKGYDGRFFDYWGQGTL
VTVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPELL
GGPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
DELTKNQVSLTCLVKGFYPSDIAVEWESNGQPENNYKTTPPVLDSDGSFFLYSKLTVDKSR
WQQGNVFSCSVMHEALHNHYTQKSLSLSPGK

508 QSVLTQPPSVSGAPGQRVTISCTGSSSNIGAGYNVHWYQQLPGTAPKLLIYTNNRRPSGVP
DRFSGSKSGTSASLAISGLRSEDEADYYCAAWDASLSGWVFGGGTKLTVLGQPKAAPSVT
LFPPSSEELQANKATLVCLISDFYPGAVTVAWKADSSPVKAGVETTTPSKQSNNKYAASS
YLSLTPEQWKSHRSYSCQVTHEGSTVEKTVAPTECS

509 EVQLLESGGGLVQPGGSLRLSCAASGFTFSSYGMHWVRQAPGKGLEWVSAIKWGGGSTG
YADSVKGRFTISRDNSKNTLYLQMNSLRAEDTAVYYCARGHHSGKDGRFFDYWGQGTL
VTVSS

510 SYGMH

511 AIKWGGGSTGYADSVKG

512 GHHSGKDGRFFDY

ANTIBODY SEQUENCES

| SEQ ID | Sequence |
|---|---|
| 513 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 514 | TGSSSNIGAGYNVH |
| 515 | TNNRRPS |
| 516 | AAWDASLSGWV |
| 517 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATTAAGTGGGGCGGAGGCTCTAC<br>AGGCTACGCCGATTCTGTGAAGGGCAGATTCACCATCAGCCGGGACAACAGCAAGAA<br>CACCCTGTACCTGCAGATGAACAGCCTGAGAGCCGAGGACACCGCCGTGTACTATTGT<br>GCCAGAGGCCACCACTCTGGCAAGGACGGCAGATTCTTCGACTATTGGGGCCAGGGC<br>ACCCTGGTCACAGTTTCTTCA |
| 518 | AGCTATGGCATGCAC |
| 519 | GCCATTAAGTGGGGCGGAGGCTCTACAGGCTACGCCGATTCTGTGAAGGGC |
| 520 | GGCCACCACTCTGGCAAGGACGGCAGATTCTTCGACTAT |
| 521 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 522 | ACAGGCAGCAGCTCCAATATCGGAGCCGGCTACAACGTGCAC |
| 523 | ACCAACAACAGACGGCCCAGC |
| 524 | GCCGCCTGGGATGCTTCTCTGAGCGGATGGGTT |
| 525 | EVQLLESGGGLVQPGGSLRLSCAASGFTFSSYGMHWVRQAPGKGLEWVSAIKWGGGSTG<br>YADSVKGRFTISRDNSKNTLYLQMNSLRAEDTAVYYCARGHHSGKDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPGK |
| 526 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 527 | EVQLLESGGGLVQPGGSLRLSCAASGFTFSSAWMSWVRQAPGKGLEWVSGISWSGGSTG<br>YALSVKGRFTISRDNSKNTLYLQMNSLRAEDTAVYYCARTYSGHYGPFFDYWGQGTLVT<br>VSS |
| 528 | SAWMS |
| 529 | GISWSGGSTGYALSVKG |
| 530 | TYSGHYGPFFDY |
| 531 | QSVLTQPPSASGTPGQRVTISCSGSSSNIGSHTVNWYQQLPGTAPKLLIYRNNQRPSGVPDR<br>FSGSKSGTSASLAISGLRSEDEADYYCAAWDDSLNGWVFGGGTKLTVL |
| 532 | SGSSSNIGSHTVN |
| 533 | RNNQRPS |
| 534 | AAWDDSLNGWV |
| 535 | GAAGTTCAGCTGCTGGAATCTGGCGGCGGACTGGTTCAACCTGGCGGATCTCTGAGAC<br>TGAGCTGTGCCGCCAGCGGCTTCACATTTTCTAGCGCCTGGATGAGCTGGGTCCGACA<br>GGCTCCTGGAAAAGGCCTGGAATGGGTGTCCGGCATCTCTTGGAGCGGCGGCTCTACA<br>GGATATGCCCTGTCTGTGAAGGGCAGATTCACCATCAGCCGGGACAACAGCAAGAAC |

ANTIBODY SEQUENCES

| SEQ ID | Sequence |
|---|---|
| | ACCCTGTACCTGCAGATGAACAGCCTGAGAGCCGAGGACACCGCCGTGTACTACTGTG<br>CCAGAACATACAGCGGCCACTACGGCCCTTTCTTCGACTATTGGGGCCAGGGCACACT<br>GGTCACAGTCTCTTCA |
| 536 | AGCGCCTGGATGAGC |
| 537 | GGCATCTCTTGGAGCGGCGGCTCTACAGGATATGCCCTGTCTGTGAAGGGC |
| 538 | ACATACAGCGGCCACTACGGCCCTTTCTTCGACTAT |
| 539 | CAGTCTGTGCTGACTCAGCCACCCTCAGCGTCTGGGACCCCCGGGCAGAGGGTCACCA<br>TCTCTTGTTCTGGAAGCAGCTCCAACATCGGAAGTCATACTGTAAACTGGTATCAGCA<br>GCTCCCAGGAACGGCCCCCAAACTCCTCATCTATAGGAATAATCAGCGGCCCTCAGGG<br>GTCCCTGACCGATTCTCTGGCTCCAAGTCTGGCACCTCAGCCTCCCTGGCCATCAGTGG<br>GCTCCGGTCCGAGGATGAGGCTGATTATTACTGTGCAGCATGGGATGACAGCCTGAAT<br>GGTTGGGTGTTCGGCGGAGGAACCAAGCTGACGGTCCTA |
| 540 | TCTGGAAGCAGCTCCAACATCGGAAGTCATACTGTAAAC |
| 541 | AGGAATAATCAGCGGCCCTCA |
| 542 | GCAGCATGGGATGACAGCCTGAATGGTTGGGTG |
| 543 | EVQLLESGGGLVQPGGSLRLSCAASGFTFSSAWMSWVRQAPGKGLEWVSGISWSGGSTG<br>YALSVKGRFTISRDNSKNTLYLQMNSLRAEDTAVYYCARTYSGHYGPFFDYWGQGTLVT<br>VSSASTKGPSVFPLAPSSKSTSGGTAALGCLVKDYFPEPVTVSWNSGALTSGVHTFPAVLQ<br>SSGLYSLSSVVTVPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEVHNAKTKPREEQY<br>NSTYRVVSVLTVLHQDWLNGKEYKCKVSNKALPAPIEKTISKAKGQPREPQVYTLPPSRD<br>ELTKNQVSLTCLVKGFYPSDIAVEWESNGQPENNYKTTPPVLDSDGSFFLYSKLTVDKSR<br>WQQGNVFSCSVMHEALHNHYTQKSLSLSPGK |
| 544 | QSVLTQPPSASGTPGQRVTISCSGSSSNIGSHTVNWYQQLPGTAPKLLIYRNNQRPSGVPDR<br>FSGSKSGTSASLAISGLRSEDEADYYCAAWDDSLNGWVFGGGTKLTVLGQPKAAPSVTLF<br>PPSSEELQANKATLVCLISDFYPGAVTVAWKADSSPVKAGVETTTPSKQSNNKYAASSYL<br>SLTPEQWKSHRSYSCQVTHEGSTVEKTVAPTECS |
| 545 | EVQLLESGGGLVQPGGSLRLSCAASGFTFSSAWMSWVRQAPGKGLEWVSGISWSGGRTG<br>YALSVKGRFTISRDNSKNTLYLQMNSLRAEDTAVYYCARTYSGHYGPYFDYWGQGTLVT<br>VSS |
| 546 | SAWMS |
| 547 | GISWSGGRTGYALSVKG |
| 548 | TYSGHYGPYFDY |
| 549 | QSVLTQPPSASGTPGQRVTISCSGSSSNIGSHTVNWYQQLPGTAPKLLIYRNNQRPSGVPDR<br>FSGSKSGTSASLAISGLRSEDEADYYCAAWDDSLNGWVFGGGTKLTVL |
| 550 | SGSSSNIGSHTVN |
| 551 | RNNQRPS |
| 552 | AAWDDSLNGWV |
| 553 | GAAGTTCAGCTGCTGGAATCTGGCGGCGGACTGGTTCAACCTGGCGGATCTCTGAGAC<br>TGAGCTGTGCCGCCAGCGGCTTCACATTTTCTAGCGCCTGGATGAGCTGGGTCCGACA<br>GGCTCCTGGAAAAGGCCTGGAATGGGTGTCCGGCATCTCTTGGAGCGGCGGCAGAAC<br>AGGATATGCCCTGTCTGTGAAGGGCAGATTCACCATCAGCCGGGACAACAGCAAGAA<br>CACCCTGTACCTGCAGATGAACAGCCTGAGAGCCGAGGACACCGCCGTGTACTACTGT<br>GCCAGAACATACAGCGGCCACTACGGCCCCTACTTCGATTATTGGGGCCAGGGCACAC<br>TGGTCACCGTTTCTTCA |
| 554 | AGCGCCTGGATGAGC |
| 555 | GGCATCTCTTGGAGCGGCGGCAGAACAGGATATGCCCTGTCTGTGAAGGGC |
| 556 | ACATACAGCGGCCACTACGGCCCCTACTTCGATTAT |
| 557 | CAGTCTGTGCTGACTCAGCCACCCTCAGCGTCTGGGACCCCCGGGCAGAGGGTCACCA<br>TCTCTTGTTCTGGAAGCAGCTCCAACATCGGAAGTCATACTGTAAACTGGTATCAGCA<br>GCTCCCAGGAACGGCCCCCAAACTCCTCATCTATAGGAATAATCAGCGGCCCTCAGGG<br>GTCCCTGACCGATTCTCTGGCTCCAAGTCTGGCACCTCAGCCTCCCTGGCCATCAGTGG |

ANTIBODY SEQUENCES

| SEQ ID | Sequence |
|---|---|
| | GCTCCGGTCCGAGGATGAGGCTGATTATTACTGTGCAGCATGGGATGACAGCCTGAAT GGTTGGGTGTTCGGCGGAGGAACCAAGCTGACGGTCCTA |
| 558 | TCTGGAAGCAGCTCCAACATCGGAAGTCATACTGTAAAC |
| 559 | AGGAATAATCAGCGGCCCTCA |
| 560 | GCAGCATGGATGACAGCCTGAATGGTTGGGTG |
| 561 | EVQLLESGGGLVQPGGSLRLSCAASGFTFSSAWMSWVRQAPGKGLEWVSGISWSGGRTG YALSVKGRFTISRDNSKNTLYLQMNSLRAEDTAVYYCARTYSGHYGPYFDYWGQGTLVT VSSASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPREPQVYTLPPSRD ELTKNQVSLTCLVKGFYPSDIAVEWESNGQPENNYKTTPPVLDSDGSFFLYSKLTVDKSR WQQGNVFSCSVMHEALHNHYTQKSLSLSPGK |
| 562 | QSVLTQPPSASGTPGQRVTISCSGSSSNIGSHTVNWYQQLPGTAPKLLIYRNNQRPSGVPDR FSGSKSGTSASLAISGLRSEDEADYYCAAWDDSLNGWVFGGGTKLTVLGQPKAAPSVTLF PPSSEELQANKATLVCLISDFYPGAVTVAWKADSSPVKAGVETTTPSKQSNNKYAASSYL SLTPEQWKSHRSYSCQVTHEGSTVEKTVAPTECS |
| 563 | EVQLLESGGGLVQPGGSLRLSCAASGFTFSSYAMSWVRQAPGKGLEWVSGIRWNNGSKG YAGSVKGRFTISRDNSKNTLYLQMNSLRAEDTAVYYCARSGNYYYGYHGMDVWGQGTL VTVSS |
| 564 | SYAMS |
| 565 | GIRWNNGSKGYAGSVKG |
| 566 | SGNYYYGYHGMDV |
| 567 | QSVLTQPPSASGTPGQRVTISCSGGNSNIGTYFVSWYQQLPGTAPKLLIYTNNQRPSGVPD RFSGSKSGTSASLAISGLRSEDEADYYCETWDSNTRVFGGGTKLTVL |
| 568 | SGGNSNIGTYFVS |
| 569 | TNNQRPS |
| 570 | ETWDSNTRV |
| 571 | GAAGTTCAGCTGCTGGAATCTGGCGGCGGACTGGTTCAACCTGGCGGATCTCTGAGAC TGAGCTGTGCCGCCAGCGGCTTCACCTTTAGCAGCTACGCCATGAGCTGGGTCCGACA GGCTCCTGGCAAAGGCCTTGAATGGGTGTCCGGCATCAGATGGAACAACGGCAGCAA GGGCTATGCCGGCTCTGTGAAGGGCAGATTCACCATCAGCCGGGACAACAGCAAGAA CACCCTGTACCTGCAGATGAACAGCCTGAGAGCCGAGGACACCGCCGTGTACTACTGT GCCAGAAGCGGCAACTACTACTACGGCTACCACGGCATGGATGTGTGGGGCCAGGGA ACACTGGTTACCGTTTCTTCA |
| 572 | AGCTACGCCATGAGC |
| 573 | GGCATCAGATGGAACAACGGCAGCAAGGGCTATGCCGGCTCTGTGAAGGGC |
| 574 | AGCGGCAACTACTACTACGGCTACCACGGCATGGATGTG |
| 575 | CAGTCTGTTCTGACACAGCCTCCTAGCGCCTCTGGCACACCTGGACAGAGAGTGACCA TCAGCTGTAGCGGCGGCAACAGCAACATCGGCACCTACTTCGTGTCCTGGTATCAGCA GCTGCCTGGCACAGCCCCTAAACTGCTGATCTACACCAACAACCAGCGGCCTAGCGGC GTGCCCGATAGATTTTCTGGCAGCAAGAGCGGCACAAGCGCCAGCCTGGCTATCTCTG GACTGAGATCTGAGGACGAGGCCGACTACTACTGCGAGACATGGGACAGCAACACCA GAGTGTTTGGCGGAGGCACCAAGCTGACAGTGCTA |
| 576 | AGCGGCGGCAACAGCAACATCGGCACCTACTTCGTGTCC |
| 577 | ACCAACAACCAGCGGCCTAGC |
| 578 | GAGACATGGGACAGCAACACCAGAGTG |
| 579 | EVQLLESGGGLVQPGGSLRLSCAASGFTFSSYAMSWVRQAPGKGLEWVSGIRWNNGSKG YAGSVKGRFTISRDNSKNTLYLQMNSLRAEDTAVYYCARSGNYYYGYHGMDVWGQGTL VTVSSASTKGPSVFPLAPSSKSTSGGTAALGCLVKDYFPEPVTVSWNSGALTSGVHTFPAV LQSSGLYSLSSVVTVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEVHNAKTKPREEQ |

ANTIBODY SEQUENCES

| SEQ ID | Sequence |
|---|---|
| | YNSTYRVVSVLTVLHQDWLNGKEYKCKVSNKALPAPIEKTISKAKGQPREPQVYTLPPSR DELTKNQVSLTCLVKGFYPSDIAVEWESNGQPENNYKTTPPVLDSDGSFFLYSKLTVDKSR WQQGNVFSCSVMHEALHNHYTQKSLSLSPGK |
| 580 | QSVLTQPPSASGTPGQRVTISCSGGNSNIGTYFVSWYQQLPGTAPKLLIYTNNQRPSGVPD RFSGSKSGTSASLAISGLRSEDEADYYCETWDSNTRVFGGGTKLTVLGQPKAAPSVTLFPP SSEELQANKATLVCLISDFYPGAVTVAWKADSSPVKAGVETTTPSKQSNNKYAASSYLSL TPEQWKSHRSYSCQVTHEGSTVEKTVAPTECS |
| | EVQLLESGGGLVQPGGSLRLSCAASGFTFSSYAMSWVRQAPGKGLEWVSGIRWNNGSKG |
| 581 | YAGSVKGRFTISRDNSKNTLYLQMNSLRAEDTAVYYCARSGNEYYGYHGMDVWGQGTL VTVSS |
| 582 | SYAMS |
| 583 | GIRWNNGSKGYAGSVKG |
| 584 | SGNEYYGYHGMDV |
| 585 | QSVLTQPPSASGTPGQRVTISCSGGNSNIGTYFVSWYQQLPGTAPKLLIYTNNQRPSGVPD RFSGSKSGTSASLAISGLRSEDEADYYCETWDSNTRVFGGGTKLTVL |
| 586 | SGGNSNIGTYFVS |
| 587 | TNNQRPS |
| 588 | ETWDSNTRV |
| 589 | GAAGTTCAGCTGCTGGAATCTGGCGGCGGACTGGTTCAACCTGGCGGATCTCTGAGAC TGAGCTGTGCCGCCAGCGGCTTCACCTTTAGCAGCTACGCCATGAGCTGGGTCCGACA GGCTCCTGGCAAAGGCCTTGAATGGGTGTCCGGCATCAGATGGAACAACGGCAGCAA GGGCTATGCCGGCTCTGTGAAGGGCAGATTCACCATCAGCGGGACAACAGCAAGAA CACCCTGTACCTGCAGATGAACAGCCTGAGAGCCGAGGACACCGCCGTGTACTACTGT GCCAGAAGCGGCAACGAGTACTACGGCTACCACGGCATGGATGTGTGGGGCCAGGGA ACACTGGTTACCGTTTCTTCA |
| 590 | AGCTACGCCATGAGC |
| 591 | GGCATCAGATGGAACAACGGCAGCAAGGGCTATGCCGGCTCTGTGAAGGGC |
| 592 | AGCGGCAACGAGTACTACGGCTACCACGGCATGGATGTG |
| 593 | CAGTCTGTTCTGACACAGCCTCCTAGCGCCTCTGGCACACCTGGACAGAGAGTGACCA TCAGCTGTAGCGGCGGCAACAGCAACATCGGCACCTACTTCGTGTCCTGGTATCAGCA GCTGCCTGGCACAGCCCCTAAACTGCTGATCTACACCAACAACCAGCGGCCTAGCGGC GTGCCCGATAGATTTTCTGGCAGCAAGAGCGGCACAAGCGCCAGCCTGGCTATCTCTG GACTGAGATCTGAGGACGAGGCCGACTACTACTGCGAGACATGGGACAGCAACACCA GAGTGTTTGGCGGAGGCACCAAGCTGACAGTGCTA |
| 594 | AGCGGCGGCAACAGCAACATCGGCACCTACTTCGTGTCC |
| 595 | ACCAACAACCAGCGGCCTAGC |
| 596 | GAGACATGGGACAGCAACACCAGAGTG |
| 597 | EVQLLESGGGLVQPGGSLRLSCAASGFTFSSYAMSWVRQAPGKGLEWVSGIRWNNGSKG YAGSVKGRFTISRDNSKNTLYLQMNSLRAEDTAVYYCARSGNEYYGYHGMDVWGQGTL VTVSSASTKGPSVFPLAPSSKSTSGGTAALGCLVKDYFPEPVTVSWNSGALTSGVHTFPAV LQSSGLYSLSSVVTVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSR DELTKNQVSLTCLVKGFYPSDIAVEWESNGQPENNYKTTPPVLDSDGSFFLYSKLTVDKSR WQQGNVFSCSVMHEALHNHYTQKSLSLSPGK |
| 598 | QSVLTQPPSASGTPGQRVTISCSGGNSNIGTYFVSWYQQLPGTAPKLLIYTNNQRPSGVPD RFSGSKSGTSASLAISGLRSEDEADYYCETWDSNTRVFGGGTKLTVLGQPKAAPSVTLFPP SSEELQANKATLVCLISDFYPGAVTVAWKADSSPVKAGVETTTPSKQSNNKYAASSYLSL TPEQWKSHRSYSCQVTHEGSTVEKTVAPTECS |
| 599 | EVQLLESGGGLVQPGGSLRLSCAASGFTFSSYGMHWVRQAPGKGLEWVSAINWNGGSTG YADSVKGRFTISRDNSKNTLYLQMNSLRAEDTAVYYCARGHHSGYDGRFFDYWGQGTL VTVSS |
| 600 | SYGMH |

ANTIBODY SEQUENCES

| SEQ ID | Sequence |
|---|---|
| 601 | AINWNGGSTGYADSVKG |
| 602 | GHHSGYDGRFFDY |
| 603 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 604 | TGSSSNIGAGYNVH |
| 605 | TNNRRPS |
| 606 | AAWDASLSGWV |
| 607 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCA |
| 608 | AGCTATGGCATGCAC |
| 609 | GCCATCAACTGGAATGGCGGCTCTACAGGCTACGCCGACTCTGTGAAGGGC |
| 610 | GGCCACCACAGCGGCTACGACGGCAGATTCTTTGACTAT |
| 611 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 612 | ACAGGCAGCAGCTCCAATATCGGAGCCGGCTACAACGTGCAC |
| 613 | ACCAACAACAGACGGCCCAGC |
| 614 | GCCGCCTGGGATGCTTCTCTGAGCGGATGGGTT |
| 615 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 616 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 617 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSS |
| 618 | SYGMH |
| 619 | AINWNGGSTGYADSVKG |
| 620 | GHHSGYDGRFFDY<br>QSVLTQPPSVSGAPGQRVTISCTGSSSNIGAGYNVHWYQQLPGTAPKLLIYTNNRRPSGVP |
| 621 | DRFSGSKSGTSASLAISGLRSEDEADYYCAAWDASLSGWVFGGGTKLTVL |
| 622 | TGSSSNIGAGYNVH |
| 623 | TNNRRPS |
| 624 | AAWDASLSGWV |

ANTIBODY SEQUENCES

| SEQ ID | Sequence |
|---|---|
| 625 | GAGGTGCAGCTGCTGGAATCTGGCGGAGGATTGGTTCAGCCTGGCGGCTCTCTGAGAC<br>TGTCTTGTGCCGCTTCCGGCTTCACCTTCTCCAGCTACGGAATGCACTGGGTCCGACAG<br>GCCCCTGGCAAAGGATTGGAATGGGTGTCCGCCATCAACTGGAACGGCGGCTCTACC<br>GGCTACGCCGATTCTGTGAAGGGCAGATTCACCATCAGCCGGGACAACTCCAAGAAC<br>ACCCTGTACCTGCAGATGAACTCCCTGAGAGCCGAGGACACCGCCGTGTACTATTGTG<br>CTAGAGGCCACCACTCTGGCTACGACGGCAGATTCTTCGACTATTGGGGCCAGGGCAC<br>CCTGGTCACAGTTTCTTCA |
| 626 | AGCTACGGAATGCAC |
| 627 | GCCATCAACTGGAACGGCGGCTCTACCGGCTACGCCGATTCTGTGAAGGGC |
| 628 | GGCCACCACTCTGGCTACGACGGCAGATTCTTCGACTAT |
| 629 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 630 | ACAGGCAGCAGCTCCAATATCGGAGCCGGCTACAACGTGCAC |
| 631 | ACCAACAACAGACGGCCCAGC |
| 632 | GCCGCCTGGGATGCTTCTCTGAGCGGATGGGTT |
| 633 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPGK |
| 634 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 660 | EVQLLESGGGLVQPGGSLRLSCAASGFTFSSYGMHWVRQAPGKGLEWVSGINWNGGSTG<br>YADSVKGRFTISRDNSKNTLYLQMNSLRAEDTAVYYCARGHHSGYDGRFFDYWGQGTL<br>VTVSS |
| 661 | SYGMH |
| 662 | GINWNGGSTGYADSVKG |
| 663 | GHHSGYDGRFFDY<br>QSVLTQPPSVSGAPGQRVTISCTGSSSNIGAGYNVHWYQQLPGTAPKLLIYTNNRRPSGVP |
| 664 | DRFSGSKSGTSASLAISGLRSEDEADYYCAAWDASLSGWVFGGGTKLTVL |
| 665 | TGSSSNIGAGYNVH |
| 666 | TNNRRPS |
| 667 | AAWDASLSGWV |
| 668 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 669 | AGCTATGGCATGCAC |
| 670 | GGCATCAACTGGAATGGCGGCTCTACAGGCTACGCCGACTCTGTGAAGGGC |
| 671 | GGCCACCACAGCGGCTACGACGGCAGATTCTTTGACTAT |

| ANTIBODY SEQUENCES | |
|---|---|
| SEQ ID | Sequence |
| 672 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 673 | ACAGGCAGCAGCTCCAATATCGGAGCCGGCTACAACGTGCAC |
| 674 | ACCAACAACAGACGGCCCAGC |
| 675 | GCCGCCTGGGATGCTTCTCTGAGCGGATGGGTT |
| 676 | EVQLLESGGGLVQPGGSLRLSCAASGFTFSSYGMHWVRQAPGKGLEWVSGINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPGK |
| 677 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 678 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCAGCCAGCACCAAGGGCCCCAGCGTGTTCCCTCTGGCCC<br>CTAGCAGCAAGAGCACATCTGGCGGAACAGCCGCCCTGGGCTGCCTCGTGAAGGACT<br>ACTTTCCCGAGCCCGTGACCGTGTCCTGGAACTCTGGCGCTCTGACAAGCGGCGTGCA<br>CACCTTTCCAGCCGTGCTGCAGAGCAGCGGCCTGTACTCTCTGAGCAGCGTCGTGACA<br>GTGCCCAGCAGCTCTCTGGGCACCCAGACCTACATCTGCAACGTGAACCACAAGCCA<br>GCAACACCAAGGTGGACAAGAAGGTGGAACCCAAGAGCTGCGACAAGACCCACACCT<br>GTCCCCCTTGTCCTGCCCCCGAACTGCTGGGAGGCCCTTCCGTGTTCCTGTTCCCCCCA<br>AAGCCCAAGGACACCCTGATGATCAGCCGGACCCCCGAAGTGACCTGCGTGGTGGTG<br>GATGTGTCCCACGAGGACCCTGAAGTGAAGTTCAATTGGTACGTGGACGGCGTGGAA<br>GTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGC<br>AAGGTGTCCAACAAGGCCCTGCCTGCCCCCATCGAGAAAACCATCAGCAAGGCCAAG<br>GGCCAGCCCCGCGAACCCCAGGTGTACACACTGCCCCCAAGCAGGGACGAGCTGACC<br>AAGAACCAGGTGTCCCTGACCTGTCTCGTGAAAGGCTTCTACCCCTCCGATATCGCCG<br>TGGAATGGGAGAGCAACGGCCAGCCCGAGAACAACTACAAGACCACCCCCCCTGTGC<br>TGGACAGCGACGGCTCATTCTTCCTGTACAGCAAGCTGACCGTGGACAAGTCCCGGTG<br>GCAGCAGGGCAACGTGTTCAGCTGCAGCGTGATGCACGAGGCCCTGCACAACCACTA<br>CACCCAGAAGTCCCTGAGCCTGAGCCCTGGCAAG |
| 679 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGTCAGCCCAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 680 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSS |
| 681 | SYGMH |
| 682 | AINWNGGSTGYADSVKG |
| 683 | GHHSGYDGRFFDY |

ANTIBODY SEQUENCES

| SEQ ID | Sequence |
|---|---|
| 684 | QSVLTQPPSASGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 685 | TGSSSNIGAGYNVH |
| 686 | TNNRRPS |
| 687 | AAWDASLSGWV |
| 688 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCA |
| 689 | AGCTATGGCATGCAC |
| 690 | GCCATCAACTGGAATGGCGGCTCTACAGGCTACGCCGACTCTGTGAAGGGC |
| 691 | GGCCACCACAGCGGCTACGACGGCAGATTCTTTGACTAT |
| 692 | CAGTCTGTTCTGACACAGCCTCCATCTGCTAGCGGAGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 693 | ACAGGCAGCAGCTCCAATATCGGAGCCGGCTACAACGTGCAC |
| 694 | ACCAACAACAGACGGCCCAGC |
| 695 | GCCGCCTGGGATGCTTCTCTGAGCGGATGGGTT |
| 696 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPGK |
| 697 | QSVLTQPPSASGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 698 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC<br>TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG |

ANTIBODY SEQUENCES

| SEQ ID | Sequence |
|---|---|
| | GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGCAAG |
| 699 | CAGTCTGTTCTGACACAGCCTCCATCTGCTAGCGGAGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 700 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCAGCCAGCACCAAGGGCCCAGCGTGTTCCCTCTGGCCC<br>CTAGCAGCAAGAGCACATCTGGCGGAACAGCCGCCCTGGGCTGCCTCGTGAAGGACT<br>ACTTTCCCGAGCCCGTGACCGTGTCCTGGAACTCTGGCGCTCTGACAAGCGGCGTGCA<br>CACCTTTCCAGCCGTGCTGCAGAGCAGCGGCCTGTACTCTCTGAGCAGCGTCGTGACA<br>GTGCCCAGCAGCTCTCTGGGCACCCAGACCTACATCTGCAACGTGAACCACAAGCCCA<br>GCAACACCAAGGTGGACAAGAAGGTGGAACCCAAGAGCTGCGACAAGACCCACACCT<br>GTCCCCCTTGTCCTGCCCCCGAACTGCTGGGAGGCCCTTCCGTGTTCCTGTTCCCCCA<br>AAGCCCAAGGACACCCTGATGATCAGCCGGACCCCCGAAGTGACCTGCGTGGTGGTG<br>GATGTGTCCCACGAGGACCCTGAAGTGAAGTTCAATTGGTACGTGGACGGCGTGGAA<br>GTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGC<br>AAGGTGTCCAACAAGGCCCTGCCTGCCCCCATCGAGAAAACCATCAGCAAGGCCAAG<br>GGCCAGCCCCGCGAACCCCAGGTGTACACACTGCCCCCAAGCAGGGACGAGCTGACC<br>AAGAACCAGGTGTCCCTGACCTGTCTCGTGAAAGGCTTCTACCCCTCCGATATCGCCG<br>TGGAATGGGAGAGCAACGGCCAGCCCGAGAACAACTACAAGACCACCCCCCCTGTGC<br>TGGACAGCGACGGCTCATTCTTCCTGTACAGCAAGCTGACCGTGGACAAGTCCCGGTG<br>GCAGCAGGGCAACGTGTTCAGCTGCAGCGTGATGCACGAGGCCCTGCACAACCACTA<br>CACCCAGAAGTCCCTGAGCCTGAGCCCTGGC |
| 701 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 702 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSS |
| 703 | HYGMH |
| 704 | GINWNGGSTGYADSVKG |
| 705 | GHHSGYDGRFFDY |
| 706 | QSVLTQPPSVSGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 707 | TGSSSNIGAGYNVH |
| 708 | TNNRRPS |
| 709 | AAWDASLSGWV |

ANTIBODY SEQUENCES

| SEQ ID | Sequence |
|---|---|
| 710 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 711 | CACTATGGCATGCAC |
| 712 | GGCATCAACTGGAATGGCGGCTCTACAGGCTACGCCGACTCTGTGAAGGGC |
| 713 | GGCCACCACAGCGGCTACGACGGCAGATTCTTTGACTAT |
| 714 | CAGTCTGTTCTGACACAGCCTCCATCCGTGTCTGGCACACCTGGCCAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCTCTAAGAGCGGCACCAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 715 | ACCGGCAGCAGCTCCAATATCGGAGCCGGCTACAACGTGCAC |
| 716 | ACCAACAACAGACGGCCCAGC |
| 717 | GCCGCCTGGGATGCTTCTCTGAGCGGATGGGTT |
| 718 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSSASTKGPSVFPLAPSSKSTSGGTAALGCLVKDYFPEPVTVSWNSGALTSGVHTFPA<br>VLQSSGLYSLSSVVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDGVEVHNAKTKPRE<br>EQYNSTYRVVSVLTVLHQDWLNGKEYKCKVSNKALPAPIEKTISKAKGQPREPQVYTLPP<br>SRDELTKNQVSLTCLVKGFYPSDIAVEWESNGQPENNYKTTPPVLDSDGSFFLYSKLTVDK<br>SRWQQGNVFSCSVMHEALHNHYTQKSLSLSPG |
| 719 | QSVLTQPPSVSGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 720 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCAGCCAGCACCAAGGGCCCCAGCGTGTTCCCTCTGGCCC<br>CTAGCAGCAAGAGCACATCTGGCGGAACAGCCGCCCTGGGCTGCCTCGTGAAGGACT<br>ACTTTCCCGAGCCCGTGACCGTGTCCTGGAACTCTGGCGCTCTGACAAGCGGCGTGCA<br>CACCTTTCCAGCCGTGCTGCAGAGCAGCGGCCTGTACTCTCTGAGCAGCGTCGTGACA<br>GTGCCCAGCAGCTCTCTGGGCACCCAGACCTACATCTGCAACGTGAACCACAAGCCCA<br>GCAACACCAAGGTGGACAAGAAGGTGGAACCCAAGAGCTGCGACAAGACCCACACCT<br>GTCCCCCTTGTCCTGCCCCCGAACTGCTGGGAGGCCCTTCCGTGTTCCTGTTCCCCCCA<br>AAGCCCAAGGACACCCTGATGATCAGCCGGACCCCCGAAGTGACCTGCGTGGTGGTG<br>GATGTGTCCCACGAGGACCCTGAAGTGAAGTTCAATTGGTACGTGGACGGCGTGGAA<br>GTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGC<br>AAGGTGTCCAACAAGGCCCTGCCTGCCCCCATCGAGAAAACCATCAGCAAGGCCAAG<br>GGCCAGCCCCGCGAACCCCAGGTGTACACACTGCCCCCAAGCAGGGACGAGCTGACC<br>AAGAACCAGGTGTCCCTGACCTGTCTCGTGAAAGGCTTCTACCCCTCCGATATCGCCG<br>TGGAATGGGAGAGCAACGGCCAGCCCGAGAACAACTACAAGACCACCCCCCCTGTCC<br>TGGACAGCGACGGCTCATTCTTCCTGTACAGCAAGCTGACCGTGGACAAGTCCCGGTG<br>GCAGCAGGGCAACGTGTTCAGCTGCAGCGTGATGCACGAGGCCCTGCACAACCACTA<br>CACCCAGAAGTCCCTGAGCCTGAGCCCTGGC |
| 721 | CAGTCTGTTCTGACACAGCCTCCATCCGTGTCTGGCACACCTGGCCAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCTCTAAGAGCGGCACCAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG |

ANTIBODY SEQUENCES

| SEQ ID | Sequence |
|---|---|
| | CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 722 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSS |
| 723 | HYGMH |
| 724 | GINWNGGSTGYADSVKG |
| 725 | GHHSGYDGRFFDY |
| | QSVLTQPPSASGAPGQRVTISCTGSSSNIGAGYNVHWYQQLPGTAPKLLIYTNNRRPSGVP |
| 726 | DRFSGSKSGTSASLAISGLRSEDEADYYCAAWDASLSGWVFGGGTKLTVL |
| 727 | TGSSSNIGAGYNVH |
| 728 | TNNRRPS |
| 729 | AAWDASLSGWV |
| 730 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 731 | CACTATGGCATGCAC |
| 732 | GGCATCAACTGGAATGGCGGCTCTACAGGCTACGCCGACTCTGTGAAGGGC |
| 733 | GGCCACCACAGCGGCTACGACGGCAGATTCTTTGACTAT |
| 734 | CAGTCTGTTCTGACACAGCCTCCATCTGCTAGCGGAGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 735 | ACAGGCAGCAGCTCCAATATCGGAGCCGGCTACAACGTGCAC |
| 736 | ACCAACAACAGACGGCCCAGC |
| 737 | GCCGCCTGGGATGCTTCTCTGAGCGGATGGGTT |
| 738 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSSASTKGPSVFPLAPSSKSTSGGTAALGCLVKDYFPEPVTVSWNSGALTSGVHTFPA<br>VLQSSGLYSLSSVVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDGVEVHNAKTKPRE<br>EQYNSTYRVVSVLTVLHQDWLNGKEYKCKVSNKALPAPIEKTISKAKGQPREPQVYTLPP<br>SRDELTKNQVSLTCLVKGFYPSDIAVEWESNGQPENNYKTTPPVLDSDGSFFLYSKLTVDK<br>SRWQQGNVFSCSVMHEALHNHYTQKSLSLSPG |
| 739 | QSVLTQPPSASGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 740 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCAGCCAGCACCAAGGGCCCCAGCGTGTTCCCTCTGGCCC<br>CTAGCAGCAAGAGCACATCTGGCGGAACAGCCGCCCTGGGCTGCCTCGTGAAGGACT |

ANTIBODY SEQUENCES

| SEQ ID | Sequence |
|---|---|
| | ACTTTCCCGAGCCCGTGACCGTGTCCTGGAACTCTGGCGCTCTGACAAGCGGCGTGCA<br>CACCTTTCCAGCCGTGCTGCAGAGCAGCGGCCTGTACTCTCTGAGCAGCGTCGTGACA<br>GTGCCCAGCAGCTCTCTGGGCACCCAGACCTACATCTGCAACGTGAACCACAAGCCCA<br>GCAACACCAAGGTGGACAAGAAGGTGGAACCCAAGAGCTGCGACAAGACCCACACCT<br>GTCCCCCTTGTCCTGCCCCCGAACTGCTGGGAGGCCCTTCCGTGTTCCTGTTCCCCCCA<br>AAGCCCAAGGACACCCTGATGATCAGCCGGACCCCCGAAGTGACCTGCGTGGTGGTG<br>GATGTGTCCCACGAGGACCCTGAAGTGAAGTTCAATTGGTACGTGGACGGCGTGGAA<br>GTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGC<br>AAGGTGTCCAACAAGGCCCTGCCTGCCCCCATCGAGAAAACCATCAGCAAGGCCAAG<br>GGCCAGCCCCGCGAACCCCAGGTGTACACACTGCCCCCAAGCAGGGACGAGCTGACC<br>AAGAACCAGGTGTCCCTGACCTGTCTCGTGAAAGGCTTCTACCCCTCCGATATCGCCG<br>TGGAATGGGAGAGCAACGGCCAGCCCGAGAACAACTACAAGACCACCCCCCCTGTGC<br>TGGACAGCGACGGCTCATTCTTCCTGTACAGCAAGCTGACCGTGGACAAGTCCGGTG<br>GCAGCAGGGCAACGTGTTCAGCTGCAGCGTGATGCACGAGGCCCTGCACAACCACTA<br>CACCCAGAAGTCCCTGAGCCTGAGCCCTGGC |
| 741 | CAGTCTGTTCTGACACAGCCTCCATCTGCTAGCGGAGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 742 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSS |
| 743 | HYGMH |
| 744 | GINWNGGSTGYADSVKG |
| 745 | GHHSGYDGRFFDY |
| 746 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 747 | TGSSSNIGAGYNVH |
| 748 | TNNRRPS |
| 749 | AAWDASLSGWV |
| 750 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 751 | CACTATGGCATGCAC |
| 752 | GGCATCAACTGGAATGGCGGCTCTACAGGCTACGCCGACTCTGTGAAGGGC |
| 753 | GGCCACCACAGCGGCTACGACGGCAGATTCTTTGACTAT |
| 754 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 755 | ACAGGCAGCAGCTCCAATATCGGAGCCGGCTACAACGTGCAC |
| 756 | ACCAACAACAGACGGCCCAGC |

ANTIBODY SEQUENCES

| SEQ ID | Sequence |
|---|---|
| 757 | GCCGCCTGGGATGCTTCTCTGAGCGGATGGGTT |
| 758 | EVQLLESGGGLVQPGGSLRLSCAASGFTFSHYGMHWVRQAPGKGLEWVSGINWNGGST GYADSVKGRFTISRDNSKNTLYLQMNSLRAEDTAVYYCARGHHSGYDGRFFDYWGQGT LVTVSSASTKGPSVFPLAPSSKSTSGGTAALGCLVKDYFPEPVTVSWNSGALTSGVHTFPA VLQSSGLYSLSSVVTVPSSSLGTQTYICNVNHKPSNTKVDKKVEPKSCDKTHTCPPCPAPE LLGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPP SRDELTKNQVSLTCLVKGFYPSDIAVEWESNGQPENNYKTTPPVLDSDGSFFLYSKLTVDK SRWQQGNVFSCSVMHEALHNHYTQKSLSLSPG |
| 759 | QSVLTQPPSVSGAPGQRVTISCTGSSSNIGAGYNVHWYQQLPGTAPKLLIYTNNRRPSGVP DRFSGSKSGTSASLAISGLRSEDEADYYCAAWDASLSGWVFGGGTKLTVLGQPKAAPSVT LFPPSSEELQANKATLVCLISDFYPGAVTVAWKADSSPVKAGVETTTPSKQSNNKYAASS YLSLTPEQWKSHRSYSCQVTHEGSTVEKTVAPTECS |
| 760 | GAAGTTCAGCTGCTGGAATCTGGCGGCGGACTGGTTCAACCTGGCGGATCTCTGAGAC TGAGCTGTGCCGCCAGCGGCTTCACCTTTAGCCACTATGGCATGCACTGGGTCCGACA GGCCCCTGGCAAAGGACTTGAATGGGTGTCCGGCATCAACTGGAATGGCGGCTCTAC AGGCTACGCCGACTCTGTGAAGGGCAGATTCACCATCAGCCGGGACAACAGCAAGAA CACCCTGTACCTGCAGATGAACTCCCTGAGAGCCGAGGACACCGCCGTGTACTATTGT GCCAGAGGCCACCACAGCGGCTACGACGGCAGATTCTTTGACTATTGGGGCCAGGGC ACCCTGGTCACAGTTTCTTCAGCCAGCACCAAGGGCCCCAGCGTGTTCCCTCTGGCCC CTAGCAGCAAGAGCACATCTGGCGGAACAGCCGCCCTGGGCTGCCTCGTGAAGGACT ACTTTCCCGAGCCCGTGACCGTGTCCTGGAACTCTGGCGCTCTGACAAGCGGCGTGCA CACCTTTCCAGCCGTGCTGCAGAGCAGCGGCCTGTACTCTCTGAGCAGCGTCGTGACA GTGCCCAGCAGCTCTCTGGGCACCCAGACCTACATCTGCAACGTGAACCACAAGCCCA GCAACACCAAGGTGGACAAGAAGGTGGAACCCAAGAGCTGCGACAAGACCCACACCT GTCCCCCTTGTCCTGCCCCCGAACTGCTGGGAGGCCCTTCCGTGTTCCTGTTCCCCCCA AAGCCCAAGGACACCCTGATGATCAGCCGGACCCCCGAAGTGACCTGCGTGGTGGTG GATGTGTCCCACGAGGACCCTGAAGTGAAGTTCAATTGGTACGTGGACGGCGTGGAA GTGCACAACGCCAAGACCAAGCCTAGAGAGGAACAGTACAACAGCACCTACCGGGTG GTGTCCGTGCTGACAGTGCTGCACCAGGACTGGCTGAACGGCAAAGAGTACAAGTGC AAGGTGTCCAACAAGGCCCTGCCTGCCCCCATCGAGAAAACCATCAGCAAGGCCAAG GGCCAGCCCCGCGAACCCCAGGTGTACACACTGCCCCCAAGCAGGGACGAGCTGACC AAGAACCAGGTGTCCCTGACCTGTCTCGTGAAAGGCTTCTACCCCTCCGATATCGCCG TGGAATGGGAGAGCAACGGCCAGCCCGAGAACAACTACAAGACCACCCCCCCTGTGC TGGACAGCGACGGCTCATTCTTCCTGTACAGCAAGCTGACCGTGGACAAGTCCCGGTG GCAGCAGGGCAACGTGTTCAGCTGCAGCGTGATGCACGAGGCCCTGCACAACCACTA CACCCAGAAGTCCCTGAGCCTGAGCCCTGGC |
| 761 | CAGTCTGTTCTGACACAGCCTCCATCTGTGTCTGGCGCCCCTGGACAGAGAGTGACCA TCAGCTGTACAGGCAGCAGCTCCAATATCGGAGCCGGCTACAACGTGCACTGGTATCA GCAGCTGCCTGGCACAGCCCCTAAACTGCTGATCTACACCAACAACAGACGGCCCAG CGGCGTGCCCGATAGATTTTCTGGCAGCAAGAGCGGCACAAGCGCCAGCCTGGCTATC TCTGGACTGAGATCTGAGGACGAGGCCGACTACTATTGCGCCGCCTGGGATGCTTCTC TGAGCGGATGGGTTTTCGGCGGAGGCACCAAACTGACAGTGCTAGGCCAGCCTAAAG CCGCCCCTAGCGTGACCCTGTTCCCTCCAAGCAGCGAGGAACTGCAGGCCAACAAGG CCACCCTCGTGTGCCTGATCAGCGACTTCTATCCTGGCGCCGTGACCGTGGCCTGGAA GGCCGATAGCTCTCCTGTGAAGGCCGGCGTGGAAACCACCACCCCTAGCAAGCAGAG CAACAACAAATACGCCGCCAGCAGCTACCTGAGCCTGACCCCCGAGCAGTGGAAGTC CCACAGATCCTACAGCTGCCAAGTGACCCACGAGGGCAGCACCGTGGAAAAGACAGT GGCCCCTACCGAGTGCAGC |
| 762 | EVQLLESGGGLVQPGGSLRLSCAASGFTFSSYGMHWVRQAPGKGLEWVSGINWNGGSTG YADSVKGRFTISRDNSKNTLYLQMNSLRAEDTAVYYCARGHHSGYDGRFFDYWGQGTL VTVSS |
| 763 | SYGMH |
| 764 | GINWNGGSTGYADSVKG |
| 765 | GHHSGYDGRFFDY |
| 766 | QSVLTQPPSASGTPGQRVTISCTGSSSNIGAGYNVHWYQQLPGTAPKLLIYTNNRRPSGVP DRFSGSKSGTSASLAISGLRSEDEADYYCAAWDASLSGWVFGGGTKLTVL |
| 767 | TGSSSNIGAGYNVH |
| 768 | TNNRRPS |
| 769 | AAWDASLSGWV |

ANTIBODY SEQUENCES

| SEQ ID | Sequence |
|---|---|
| 770 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 771 | AGCTATGGCATGCAC |
| 772 | GGCATCAACTGGAATGGCGGCTCTACAGGCTACGCCGACTCTGTGAAGGGC |
| 773 | GGCCACCACAGCGGCTACGACGGCAGATTCTTTGACTAT |
| 774 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 775 | ACCGGCAGCAGCTCCAATATCGGAGCCGGCTACAACGTGCAC |
| 776 | ACCAACAACAGACGGCCCAGC |
| 777 | GCCGCCTGGGATGCTTCTCTGAGCGGATGGGTT |
| 778 | EVQLLESGGGLVQPGGSLRLSCAASGFTFSSYGMHWVRQAPGKGLEWVSGINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 779 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 780 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCAGCCAGCACCAAGGGCCCCAGCGTGTTCCCTCTGGCCC<br>CTAGCAGCAAGAGCACATCTGGCGGAACAGCCGCCCTGGGCTGCCTCGTGAAGGACT<br>ACTTTCCCGAGCCCGTGACCGTGTCCTGGAACTCTGGCGCTCTGACAAGCGGCGTGCA<br>CACCTTTCCAGCCGTGCTGCAGAGCAGCGGCCTGTACTCTCTGAGCAGCGTCGTGACA<br>GTGCCCAGCAGCTCTCTGGGCACCCAGACCTACATCTGCAACGTGAACCACAAGCCCA<br>GCAACACCAAGGTGGACAAGAAGGTGGAACCCAAGAGCTGCGACAAGACCCACACCT<br>GTCCCCCTTGTCCTGCCCCCGAACTGCTGGGAGGCCCTTCCGTGTTCCTGTTCCCCCCA<br>AAGCCCAAGGACACCCTGATGATCAGCCGGACCCCCGAAGTGACCTGCGTGGTGGTG<br>GATGTGTCCCACGAGGACCCTGAAGTGAAGTTCAATTGGTACGTGGACGGCGTGGAA<br>GTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGC<br>AAGGTGTCCAACAAGGCCCTGCCTGCCCCCATCGAGAAAACCATCAGCAAGGCCAAG<br>GGCCAGCCCCGCGAACCCCAGGTGTACACACTGCCCCCAAGCAGGGACGAGCTGACC<br>AAGAACCAGGTGTCCCTGACCTGTCTCGTGAAAGGCTTCTACCCCTCCGATATCGCCG<br>TGGAATGGGAGAGCAACGGCCAGCCCGAGAACAACTACAAGACCACCCCCCCTGTGC<br>TGGACAGCGACGGCTCATTCTTCCTGTACAGCAAGCTGACCGTGGACAAGTCCCGGTG<br>GCAGCAGGGCAACGTGTTCAGCTGCAGCGTGATGCACGAGGCCCTGCACAACCACTA<br>CACCCAGAAGTCCCTGAGCCTGAGCCCTGGC |
| 781 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG |

ANTIBODY SEQUENCES

| SEQ ID | Sequence |
|---|---|
| | CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 782 | EVQLLESGGGLVQPGGSLRLSCAASGFTFSHYGMHWVRQAPGKGLEWVSAINWNGGST<br>GYADSVKGRFTISRDNSKNTLYLQMNSLRAEDTAVYYCARGHHSGYDGRFFDYWGQGT<br>LVTVSS |
| 783 | HYGMH |
| 784 | AINWNGGSTGYADSVKG |
| 785 | GHHSGYDGRFFDY |
| 786 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 787 | TGSSSNIGAGYNVH |
| 788 | TNNRRPS |
| 789 | AAWDASLSGWV |
| 790 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCA |
| 791 | CACTATGGCATGCAC |
| 792 | GCCATCAACTGGAATGGCGGCTCTACAGGCTACGCCGACTCTGTGAAGGGC |
| 793 | GGCCACCACAGCGGCTACGACGGCAGATTCTTTGACTAT |
| 794 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 795 | ACCGGCAGCAGCTCCAATATCGGAGCCGGCTACAACGTGCAC |
| 796 | ACCAACAACAGACGGCCCAGC |
| 797 | GCCGCCTGGGATGCTTCTCTGAGCGGATGGGTT |
| 798 | EVQLLESGGGLVQPGGSLRLSCAASGFTFSHYGMHWVRQAPGKGLEWVSAINWNGGST<br>GYADSVKGRFTISRDNSKNTLYLQMNSLRAEDTAVYYCARGHHSGYDGRFFDYWGQGT<br>LVTVSSASTKGPSVFPLAPSSKSTSGGTAALGCLVKDYFPEPVTVSWNSGALTSGVHTFPA<br>VLQSSGLYSLSSVVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDGVEVHNAKTKPRE<br>EQYNSTYRVVSVLTVLHQDWLNGKEYKCKVSNKALPAPIEKTISKAKGQPREPQVYTLPP<br>SRDELTKNQVSLTCLVKGFYPSDIAVEWESNGQPENNYKTTPPVLDSDGSFFLYSKLTVDK<br>SRWQQGNVFSCSVMHEALHNHYTQKSLSLSPG |
| 799 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 800 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC |

ANTIBODY SEQUENCES

| SEQ ID | Sequence |
|---|---|
| | TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG<br>GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGC |
| 801 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 802 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSS |
| 803 | SYGMH |
| 804 | AINWNGGSTGYADSVKG |
| 805 | GHHSGYDGRFFDY |
| 806 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 807 | TGSSSNIGAGYNVH |
| 808 | TNNRRPS |
| 809 | AAWDASLSGWV |
| 810 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCA |
| 811 | AGCTATGGCATGCAC |
| 812 | GCCATCAACTGGAATGGCGGCTCTACAGGCTACGCCGACTCTGTGAAGGGC |
| 813 | GGCCACCACAGCGGCTACGACGGCAGATTCTTTGACTAT |
| 814 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 815 | ACCGGCAGCAGCTCCAATATCGGAGCCGGCTACAACGTGCAC |
| 816 | ACCAACAACAGACGGCCCAGC |

ANTIBODY SEQUENCES

| SEQ ID | Sequence |
|---|---|
| 817 | GCCGCCTGGGATGCTTCTCTGAGCGGATGGGTT |
| 818 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 819 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 820 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC<br>TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG<br>GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGC |
| 821 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 822 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC<br>TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG |

ANTIBODY SEQUENCES

| SEQ ID | Sequence |
|---|---|
| | GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGC |
| 823 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 824 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC<br>TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG<br>GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGCAAG |
| 825 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 826 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSS |
| 827 | SYGMH |
| 828 | AINWNGGSTGYADSVKG |
| 829 | GHHSGYDGRFFDY |
| 830 | QSVLTQPPSVSGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 831 | TGSSSNIGAGYNVH |
| 832 | TNNRRPS |
| 833 | AAWDASLSGWV |

ANTIBODY SEQUENCES

| SEQ ID | Sequence |
|---|---|
| 834 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCA |
| 835 | AGCTATGGCATGCAC |
| 836 | GCCATCAACTGGAATGGCGGCTCTACAGGCTACGCCGACTCTGTGAAGGGC |
| 837 | GGCCACCACAGCGGCTACGACGGCAGATTCTTTGACTAT |
| 838 | CAGTCTGTTCTGACACAGCCTCCATCCGTGTCTGGCACACCTGGCCAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCTCTAAGAGCGGCACCAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 839 | ACCGGCAGCAGCTCCAATATCGGAGCCGGCTACAACGTGCAC |
| 840 | ACCAACAACAGACGGCCCAGC |
| 841 | GCCGCCTGGGATGCTTCTCTGAGCGGATGGGTT |
| 842 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 843 | QSVLTQPPSVSGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 844 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC<br>TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG<br>GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGC |
| 845 | CAGTCTGTTCTGACACAGCCTCCATCCGTGTCTGGCACACCTGGCCAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCTCTAAGAGCGGCACCAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG |

ANTIBODY SEQUENCES

| SEQ ID | Sequence |
|---|---|
| | CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 846 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSS |
| 847 | SYGMH |
| 848 | AINWNGGSTGYADSVKG |
| 849 | GHHSGYDGRFFDY |
| 850 | QSVLTQPPSASGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 851 | TGSSSNIGAGYNVH |
| 852 | TNNRRPS |
| 853 | AAWDASLSGWV |
| 854 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCA |
| 855 | AGCTATGGCATGCAC |
| 856 | GCCATCAACTGGAATGGCGGCTCTACAGGCTACGCCGACTCTGTGAAGGGC |
| 857 | GGCCACCACAGCGGCTACGACGGCAGATTCTTTGACTAT |
| 858 | CAGTCTGTTCTGACACAGCCTCCATCTGCTAGCGGAGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 859 | ACAGGCAGCAGCTCCAATATCGGAGCCGGCTACAACGTGCAC |
| 860 | ACCAACAACAGACGGCCCAGC |
| 861 | GCCGCCTGGGATGCTTCTCTGAGCGGATGGGTT |
| 862 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPG |
| 863 | QSVLTQPPSASGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 864 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC |

ANTIBODY SEQUENCES

| SEQ ID | Sequence |
|---|---|
| | TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG<br>GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGC |
| 865 | CAGTCTGTTCTGACACAGCCTCCATCTGCTAGCGGAGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 866 | EVQLLESGGGLVQPGGSLRLSCAASGFTFSSYGMHWVRQAPGKGLEWVSGINWNGGSTG<br>YADSVKGRFTISRDNSKNTLYLQMNSLRAEDTAVYYCARGHHSGYDGRFFDYWGQGTL<br>VTVSS |
| 867 | SYGMH |
| 868 | GINWNGGSTGYADSVKG |
| 869 | GHHSGYDGRFFDY |
| | QSVLTQPPSVSGAPGQRVTISCTGSSSNIGAGYNVHWYQQLPGTAPKLLIYTNNRRPSGVP |
| 870 | DRFSGSKSGTSASLAISGLRSEDEADYYCAAWDASLSGWVFGGGTKLTVL |
| 871 | TGSSSNIGAGYNVH |
| 872 | TNNRRPS |
| 873 | AAWDASLSGWV |
| 874 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 875 | AGCTATGGCATGCAC |
| 876 | GGCATCAACTGGAATGGCGGCTCTACAGGCTACGCCGACTCTGTGAAGGGC |
| 877 | GGCCACCACAGCGGCTACGACGGCAGATTCTTTGACTAT |
| 878 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 879 | ACAGGCAGCAGCTCCAATATCGGAGCCGGCTACAACGTGCAC |
| 880 | ACCAACAACAGACGGCCCAGC |

| | ANTIBODY SEQUENCES |
|---|---|
| SEQ ID | Sequence |
| 881 | GCCGCCTGGGATGCTTCTCTGAGCGGATGGGTT |
| 882 | EVQLLESGGGLVQPGGSLRLSCAASGFTFSSYGMHWVRQAPGKGLEWVSGINWNGGSTG YADSVKGRFTISRDNSKNTLYLQMNSLRAEDTAVYYCARGHHSGYDGRFFDYWGQGTL VTVSSASTKGPSVFPLAPSSKSTSGGTAALGCLVKDYFPEPVTVSWNSGALTSGVHTFPAV LQSSGLYSLSSVVTVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSR DELTKNQVSLTCLVKGFYPSDIAVEWESNGQPENNYKTTPPVLDSDGSFFLYSKLTVDKSR WQQGNVFSCSVMHEALHNHYTQKSLSLSPG |
| 883 | QSVLTQPPSVSGAPGQRVTISCTGSSSNIGAGYNVHWYQQLPGTAPKLLIYTNNRRPSGVP DRFSGSKSGTSASLAISGLRSEDEADYYCAAWDASLSGWVFGGGTKLTVLGQPKAAPSVT LFPPSSEELQANKATLVCLISDFYPGAVTVAWKADSSPVKAGVETTTPSKQSNNKYAASS YLSLTPEQWKSHRSYSCQVTHEGSTVEKTVAPTECS |
| 884 | GAAGTTCAGCTGCTGGAATCTGGCGGCGGACTGGTTCAACCTGGCGGATCTCTGAGAC TGAGCTGTGCCGCCAGCGGCTTCACCTTTAGCAGCTATGGCATGCACTGGGTCCGACA GGCCCCTGGCAAAGGACTTGAATGGGTGTCCGGCATCAACTGGAATGGCGGCTCTAC AGGCTACGCCGACTCTGTGAAGGGCAGATTCACCATCAGCCGGGACAACAGCAAGAA CACCCTGTACCTGCAGATGAACTCCCTGAGAGCCGAGGACACCGCCGTGTACTATTGT GCCAGAGGCCACCACAGCGGCTACGACGGCAGATTCTTTGACTATTGGGGCCAGGGC ACCCTGGTCACAGTTTCTTCAGCCAGCACCAAGGGCCCCAGCGTGTTCCCTCTGGCCC CTAGCAGCAAGAGCACATCTGGCGGAACAGCCGCCCTGGGCTGCCTCGTGAAGGACT ACTTTCCCGAGCCCGTGACCGTGTCCTGGAACTCTGGCGCTCTGACAAGCGGCGTGCA CACCTTTCCAGCCGTGCTGCAGAGCAGCGGCCTGTACTCTCTGAGCAGCGTCGTGACA GTGCCCAGCAGCTCTCTGGGCACCCAGACCTACATCTGCAACGTGAACCACAAGCCCA GCAACACCAAGGTGGACAAGAAGGTGGAACCCAAGAGCTGCGACAAGACCCACACCT GTCCCCCTTGTCCTGCCCCCGAACTGCTGGGAGGCCCTTCCGTGTTCCTGTTCCCCCCA AAGCCCAAGGACACCCTGATGATCAGCCGGACCCCCGAAGTGACCTGCGTGGTGGTG GATGTGTCCCACGAGGACCCTGAAGTGAAGTTCAATTGGTACGTGGACGGCGTGGAA GTGCACAACGCCAAGACCAAGCCTAGAGAGGAACAGTACAACAGCACCTACCGGGTG GTGTCCGTGCTGACAGTGCTGCACCAGGACTGGCTGAACGGCAAAGAGTACAAGTGC AAGGTGTCCAACAAGGCCCTGCCTGCCCCCATCGAGAAAACCATCAGCAAGGCCAAG GGCCAGCCCCGCGAACCCCAGGTGTACACACTGCCCCCAAGCAGGGACGAGCTGACC AAGAACCAGGTGTCCCTGACCTGTCTCGTGAAAGGCTTCTACCCCTCCGATATCGCCG TGGAATGGGAGAGCAACGGCCAGCCCGAGAACAACTACAAGACCACCCCCCCTGTGC TGGACAGCGACGGCTCATTCTTCCTGTACAGCAAGCTGACCGTGGACAAGTCCCGGTG GCAGCAGGGCAACGTGTTCAGCTGCAGCGTGATGCACGAGGCCCTGCACAACCACTA CACCCAGAAGTCCCTGAGCCTGAGCCCTGGC |
| 885 | CAGTCTGTTCTGACACAGCCTCCATCTGTGTCTGGCGCCCCTGGACAGAGAGTGACCA TCAGCTGTACAGGCAGCAGCTCCAATATCGGAGCCGGCTACAACGTGCACTGGTATCA GCAGCTGCCTGGCACAGCCCCTAAACTGCTGATCTACACCAACAACAGACGGCCCAG CGGCGTGCCCGATAGATTTTCTGGCAGCAAGAGCGGCACAAGCGCCAGCCTGGCTATC TCTGGACTGAGATCTGAGGACGAGGCCGACTACTATTGCGCCGCCTGGGATGCTTCTC TGAGCGGATGGGTTTTCGGCGGAGGCACCAAACTGACAGTGCTAGGCCAGCCTAAAG CCGCCCCTAGCGTGACCCTGTTCCCTCCAAGCAGCGAGGAACTGCAGGCCAACAAGG CCACCCTCGTGTGCCTGATCAGCGACTTCTATCCTGGCGCCGTGACCGTGGCCTGGAA GGCCGATAGCTCTCCTGTGAAGGCCGGCGTGGAAACCACCACCCCTAGCAAGCAGAG CAACAACAAATACGCCGCCAGCAGCTACCTGAGCCTGACCCCCGAGCAGTGGAAGTC CCACAGATCCTACAGCTGCCAAGTGACCCACGAGGGCAGCACCGTGGAAAAGACAGT GGCCCCTACCGAGTGCAGC |
| 886 | EVQLLESGGGLVQPGGSLRLSCAASGFTFSHYGMHWVRQAPGKGLEWVSAINWNGGST GYADSVKGRFTISRDNSKNTLYLQMNSLRAEDTAVYYCARGHHSGYDGRFFDYWGQGT LVTVSS |
| 887 | HYGMH |
| 888 | AINWNGGSTGYADSVKG |
| 889 | GHHSGYDGRFFDY |
| 890 | QSVLTQPPSVSGAPGQRVTISCTGSSSNIGAGYNVHWYQQLPGTAPKLLIYTNNRRPSGVP DRFSGSKSGTSASLAISGLRSEDEADYYCAAWDASLSGWVFGGGTKLTVL |
| 891 | TGSSSNIGAGYNVH |
| 892 | TNNRRPS |
| 893 | AAWDASLSGWV |

ANTIBODY SEQUENCES

| SEQ ID | Sequence |
|---|---|
| 894 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCA |
| 895 | CACTATGGCATGCAC |
| 896 | GCCATCAACTGGAATGGCGGCTCTACAGGCTACGCCGACTCTGTGAAGGGC |
| 897 | GGCCACCACAGCGGCTACGACGGCAGATTCTTTGACTAT |
| 898 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 899 | ACAGGCAGCAGCTCCAATATCGGAGCCGGCTACAACGTGCAC |
| 900 | ACCAACAACAGACGGCCCAGC |
| 901 | GCCGCCTGGGATGCTTCTCTGAGCGGATGGGTT |
| 902 | EVQLLESGGGLVQPGGSLRLSCAASGFTFSHYGMHWVRQAPGKGLEWVSAINWNGGST<br>GYADSVKGRFTISRDNSKNTLYLQMNSLRAEDTAVYYCARGHHSGYDGRFFDYWGQGT<br>LVTVSSASTKGPSVFPLAPSSKSTSGGTAALGCLVKDYFPEPVTVSWNSGALTSGVHTFPA<br>VLQSSGLYSLSSVVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDGVEVHNAKTKPRE<br>EQYNSTYRVVSVLTVLHQDWLNGKEYKCKVSNKALPAPIEKTISKAKGQPREPQVYTLPP<br>SRDELTKNQVSLTCLVKGFYPSDIAVEWESNGQPENNYKTTPPVLDSDGSFFLYSKLTVDK<br>SRWQQGNVFSCSVMHEALHNHYTQKSLSLSPG |
| 903 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 904 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGTG<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCCAGCGTGTTCCCTCTGGCCCCT<br>AGCAGCAAGAGCACATCTGGCGGAACAGCCGCCCTGGGCTGCCTCGTGAAGGACTAC<br>TTTCCCGAGCCCGTGACCGTGTCCTGGAACTCTGGCGCTTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG<br>GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGC |
| 905 | CAGTCTGTTCTGACACAGCCTCCATCTGTGTCTGGCGCCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA |

ANTIBODY SEQUENCES

| SEQ ID | Sequence |
|---|---|
| | GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 906 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSS |
| 907 | HYGMH |
| 908 | GINWNGGSTGYADSVKG |
| 909 | GHHSGYDGRFFDY |
| 910 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 911 | TGSSSNIGAGYNVH |
| 912 | TNNRRPS |
| 913 | AAWDASLSGWV |
| 914 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 915 | CACTATGGCATGCAC |
| 916 | GGCATCAACTGGAATGGCGGCTCTACAGGCTACGCCGACTCTGTGAAGGGC |
| 917 | GGCCACCACAGCGGCTACGACGGCAGATTCTTTGACTAT |
| 918 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 919 | ACCGGCAGCAGCTCCAATATCGGAGCCGGCTACAACGTGCAC |
| 920 | ACCAACAACAGACGGCCCAGC |
| 921 | GCCGCCTGGGATGCTTCTCTGAGCGGATGGGTT |
| 922 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSSASTKGPSVFPLAPSSKSTSGGTAALGCLVKDYFPEPVTVSWNSGALTSGVHTFPA<br>VLQSSGLYSLSSVVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDGVEVHNAKTKPRE<br>EQYNSTYRVVSVLTVLHQDWLNGKEYKCKVSNKALPAPIEKTISKAKGQPREPQVYTLPP<br>SRDELTKNQVSLTCLVKGFYPSDIAVEWESNGQPENNYKTTPPVLDSDGSFFLYSKLTVDK<br>SRWQQGNVFSCSVMHEALHNHYTQKSLSLSPGK |
| 923 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 924 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCAGCCAGCACCAAGGGCCCCAGCGTGTTCCCTCTGGCCC<br>CTAGCAGCAAGAGCACATCTGGCGGAACAGCCGCCCTGGGCTGCCTCGTGAAGGACT<br>ACTTTCCCGAGCCCGTGACCGTGTCCTGGAACTCTGGCGCTCTGACAAGCGGCGTGCA |

ANTIBODY SEQUENCES

| SEQ ID | Sequence |
|---|---|
| | CACCTTTCCAGCCGTGCTGCAGAGCAGCGGCCTGTACTCTCTGAGCAGCGTCGTGACA<br>GTGCCCAGCAGCTCTCTGGGCACCCAGACCTACATCTGCAACGTGAACCACAAGCCCA<br>GCAACACCAAGGTGGACAAGAAGGTGGAACCCAAGAGCTGCGACAAGACCCACACCT<br>GTCCCCCTTGTCCTGCCCCGAACTGCTGGGAGGCCCTTCCGTGTTCCTGTTCCCCCCA<br>AAGCCCAAGGACACCCTGATGATCAGCCGGACCCCCGAAGTGACCTGCGTGGTGGTG<br>GATGTGTCCCACGAGGACCCTGAAGTGAAGTTCAATTGGTACGTGGACGGCGTGGAA<br>GTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGC<br>AAGGTGTCCAACAAGGCCCTGCCTGCCCCATCGAGAAAACCATCAGCAAGGCCAAG<br>GGCCAGCCCCGCGAACCCCAGGTGTACACACTGCCCCCAAGCAGGGACGAGCTGACC<br>AAGAACCAGGTGTCCCTGACCTGTCTCGTGAAAGGCTTCTACCCCTCCGATATCGCCG<br>TGGAATGGGAGAGCAACGGCCAGCCCGAGAACAACTACAAGACCACCCCCCCTGTGC<br>TGGACAGCGACGGCTCATTCTTCCTGTACAGCAAGCTGACCGTGGACAAGTCCCGGTG<br>GCAGCAGGGCAACGTGTTCAGCTGCAGCGTGATGCACGAGGCCCTGCACAACCACTA<br>CACCCAGAAGTCCCTGAGCCTGAGCCCTGGCAAG |
| 925 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC<br>CCACAGATCCTACAGCTGCCAAGTGACCCACGAGGGCAGCACCGTGGAAAAGACAGT<br>GGCCCCTACCGAGTGCAGC |
| 926 | EVQLLESGGGLVQPGGSLRLSCAASGFTFSHYGMHWVRQAPGKGLEWVSGINWNGGST<br>GYADSVKGRFTISRDNSKNTLYLQMNSLRAEDTAVYYCARGHHSGYDGRFFDYWGQGT<br>LVTVSS |
| 927 | HYGMH |
| 928 | GINWNGGSTGYADSVKG |
| 929 | GHHSGYDGRFFDY |
| 930 | QSVLTQPPSVSGAPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVL |
| 931 | TGSSSNIGAGYNVH |
| 932 | TNNRRPS |
| 933 | AAWDASLSGWV |
| 934 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCCACTATGGCATGCACTGGGTCCGACA<br>GGCCCCTGGCAAAGGACTTGAATGGGTGTCCGGCATCAACTGGAATGGCGGCTCTAC<br>AGGCTACGCCGACTCTGTGAAGGGCAGATTCACCATCAGCCGGGACAACAGCAAGAA<br>CACCCTGTACCTGCAGATGAACTCCCTGAGAGCCGAGGACACCGCCGTGTACTATTGT<br>GCCAGAGGCCACCACAGCGGCTACGACGGCAGATTCTTTGACTATTGGGGCCAGGGC<br>ACCCTGGTCACAGTTTCTTCA |
| 935 | CACTATGGCATGCAC |
| 936 | GGCATCAACTGGAATGGCGGCTCTACAGGCTACGCCGACTCTGTGAAGGGC |
| 937 | GGCCACCACAGCGGCTACGACGGCAGATTCTTTGACTAT |
| 938 | CAGTCTGTTCTGACACAGCCTCCATCTGTGTCTGGCGCCCTGGACAGAGAGTGACCA<br>TCAGCTGTACAGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 939 | ACAGGCAGCAGCTCCAATATCGGAGCCGGCTACAACGTGCAC |
| 940 | ACCAACAACAGACGGCCCAGC |
| 941 | GCCGCCTGGGATGCTTCTCTGAGCGGATGGGTT |

ANTIBODY SEQUENCES

| SEQ ID | Sequence |
|---|---|
| 942 | EVQLLESGGGLVQPGGSLRLSCAASGFTFSHYGMHWVRQAPGKGLEWVSGINWNGGST GYADSVKGRFTISRDNSKNTLYLQMNSLRAEDTAVYYCARGHHSGYDRFFDYWGQGT LVTVSSASTKGPSVFPLAPSSKSTSGGTAALGCLVKDYFPEPVTVSWNSGALTSGVHTFPA VLQSSGLYSLSSVVTVPSSSLGTQTYICNVNHKPSNTKVDKKVEPKSCDKTHTCPPCPAPE LLGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPP SRDELTKNQVSLTCLVKGFYPSDIAVEWESNGQPENNYKTTPPVLDSDGSFFLYSKLTVDK SRWQQGNVFSCSVMHEALHNHYTQKSLSLSPGK |
| 943 | QSVLTQPPSVSGAPGQRVTISCTGSSSNIGAGYNVHWYQQLPGTAPKLLIYTNNRRPSGVP DRFSGSKSGTSASLAISGLRSEDEADYYCAAWDASLSGWVFGGGTKLTVLGQPKAAPSVT LFPPSSEELQANKATLVCLISDFYPGAVTVAWKADSSPVKAGVETTTPSKQSNNKYAASS YLSLTPEQWKSHRSYSCQVTHEGSTVEKTVAPTECS |
| 944 | GAAGTTCAGCTGCTGGAATCTGGCGGCGGACTGGTTCAACCTGGCGGATCTCTGAGAC TGAGCTGTGCCGCCAGCGGCTTCACCTTTAGCCACTATGGCATGCACTGGGTCCGACA GGCCCCTGGCAAAGGACTTGAATGGGTGTCCGGCATCAACTGGAATGGCGGCTCTAC AGGCTACGCCGACTCTGTGAAGGGCAGATTCACCATCAGCCGGGACAACAGCAAGAA CACCCTGTACCTGCAGATGAACTCCCTGAGAGCCGAGGACACCGCCGTGTACTATTGT GCCAGAGGCCACCACAGCGGCTACGACGGCAGATTCTTTGACTATTGGGGCCAGGGC ACCCTGGTCACAGTTTCTTCAGCCAGCACCAAGGGCCCCAGCGTGTTCCCTCTGGCCC CTAGCAGCAAGAGCACATCTGGCGGAACAGCCGCCCTGGGCTGCCTCGTGAAGGACT ACTTTCCCGAGCCCGTGACCGTGTCCTGGAACTCTGGCGCTCTGACAAGCGGCGTGCA CACCTTTCCAGCCGTGCTGCAGAGCAGCGGCCTGTACTCTCTGAGCAGCGTCGTGACA GTGCCCAGCAGCTCTCTGGGCACCCAGACCTACATCTGCAACGTGAACCACAAGCCCA GCAACACCAAGGTGGACAAGAAGGTGGAACCCAAGAGCTGCGACAAGACCCACACCT GTCCCCCTTGTCCTGCCCCCGAACTGCTGGGAGGCCCTTCCGTGTTCCTGTTCCCCCCA AAGCCCAAGGACACCCTGATGATCAGCCGGACCCCCGAAGTGACCTGCGTGGTGGTG GATGTGTCCCACGAGGACCCTGAAGTGAAGTTCAATTGGTACGTGGACGGCGTGGAA GTGCACAACGCCAAGACCAAGCCTAGAGAGGAACAGTACAACAGCACCTACCGGGTG GTGTCCGTGCTGACAGTGCTGCACCAGGACTGGCTGAACGGCAAAGAGTACAAGTGC AAGGTGTCCAACAAGGCCCTGCCTGCCCCCATCGAGAAAACCATCAGCAAGGCCAAG GGCCAGCCCCGCGAACCCCAGGTGTACACACTGCCCCCAAGCAGGGACGAGCTGACC AAGAACCAGGTGTCCCTGACCTGTCTCGTGAAAGGCTTCTACCCCTCCGATATCGCCG TGGAATGGGAGAGCAACGGCCAGCCCGAGAACAACTACAAGACCACCCCCCCTGTGC TGGACAGCGACGGCTCATTCTTCCTGTACAGCAAGCTGACCGTGGACAAGTCCCGGTG GCAGCAGGGCAACGTGTTCAGCTGCAGCGTGATGCACGAGGCCCTGCACAACCACTA CACCCAGAAGTCCCTGAGCCTGAGCCCTGGCAAG |
| 945 | CAGTCTGTTCTGACACAGCCTCCATCTGTGTCTGGCGCCCCTGGACAGAGAGTGACCA TCAGCTGTACAGGCAGCAGCTCCAATATCGGAGCCGGCTACAACGTGCACTGGTATCA GCAGCTGCCTGGCACAGCCCCTAAACTGCTGATCTACACCAACAACAGACGGCCCAG CGGCGTGCCCGATAGATTTTCTGGCAGCAAGAGCGGCACAAGCGCCAGCCTGGCTATC TCTGGACTGAGATCTGAGGACGAGGCCGACTACTATTGCGCCGCCTGGGATGCTTCTC TGAGCGGATGGGTTTTCGGCGGAGGCACCAAACTGACAGTGCTAGGCCAGCCTAAAG CCGCCCCTAGCGTGACCCTGTTCCCTCCAAGCAGCGAGGAACTGCAGGCCAACAAGG CCACCCTCGTGTGCCTGATCAGCGACTTCTATCCTGGCGCCGTGACCGTGGCCTGGAA GGCCGATAGCTCTCCTGTGAAGGCCGGCGTGGAAACCACCACCCCTAGCAAGCAGAG CAACAACAAATACGCCGCCAGCAGCTACCTGAGCCTGACCCCCGAGCAGTGGAAGTC CACAGATCCTACAGCTGCCAAGTGACCCACGAGGGCAGCACCGTGGAAAAGACAGT GGCCCCTACCGAGTGCAGC |
| 946 | EVQLLESGGGLVQPGGSLRLSCAASGFTFSSYGMHWVRQAPGKGLEWVSAINWNGGSTG YADSVKGRFTISRDNSKNTLYLQMNSLRAEDTAVYYCARGHHSGYDGRFFDYWGQGTL VTVSS |
| 947 | SYGMH |
| 948 | AINWNGGSTGYADSVKG |
| 949 | GHHSGYDGRFFDY |
| 950 | QSVLTQPPSASGTPGQRVTISCTGSSSNIGAGYNVHWYQQLPGTAPKLLIYTNNRRPSGVP DRFSGSKSGTSASLAISGLRSEDEADYYCAAWDASLSGWVFGGGTKLTVL |
| 951 | TGSSSNIGAGYNVH |
| 952 | TNNRRPS |
| 953 | AAWDASLSGWV |
| 954 | GAAGTTCAGCTGCTGGAATCTGGCGGCGGACTGGTTCAACCTGGCGGATCTCTGAGAC TGAGCTGTGCCGCCAGCGGCTTCACCTTTAGCAGCTATGGCATGCACTGGGTCCGACA |

ANTIBODY SEQUENCES

| SEQ ID | Sequence |
|---|---|
| | GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGT<br>CCAGAGGCCACCACAGCGGCTACGACGGCAGATTCTTTGACTATTGGGGCCAGGGCA<br>CCCTGGTCACAGTTTCTTCA |
| 955 | AGCTATGGCATGCAC |
| 956 | GCCATCAACTGGAATGGCGGCTCTACAGGCTACGCCGACTCTGTGAAGGGC |
| 957 | GGCCACCACAGCGGCTACGACGGCAGATTCTTTGACTAT |
| 958 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTA |
| 959 | ACCGGCAGCAGCTCCAATATCGGAGCCGGCTACAACGTGCAC |
| 960 | ACCAACAACAGACGGCCCAGC |
| 961 | GCCGCCTGGGATGCTTCTCTGAGCGGATGGGTT |
| 962 | EVQLLESGGGLVQPGGSLRLSCAASGFTFSSYGMHWVRQAPGKGLEWVSAINWNGGSTG<br>YADSVKGRFTISRDNSKNTLYLQMNSLRAEDTAVYYCARGHHSGYDGRFFDYWGQGTL<br>VTVSSASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKKVEPKSCDKTHTCPPCPAPELL<br>GGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSKLTVDKSR<br>WQQGNVFSCSVMHEALHNHYTQKSLSLSPGK |
| 963 | QSVLTQPPSASGTPGQRVTISCTGSSSNIGAGYNVHWYQQLPGTAPKLLIYTNNRRPSGVP<br>DRFSGSKSGTSASLAISGLRSEDEADYYCAAWDASLSGWVFGGGTKLTVLGQPKAAPSVT<br>LFPPSSEELQANKATLVCLISDFYPGAVTVAWKADSSPVKAGVETTTPSKQSNNKYAASS<br>YLSLTPEQWKSHRSYSCQVTHEGSTVEKTVAPTECS |
| 964 | GAAGTTCAGCTGCTGGAATCTGGCGGCGGACTGGTTCAACCTGGCGGATCTCTGAGAC<br>TGAGCTGTGCCGCCAGCGGCTTCACCTTTAGCAGCTATGGCATGCACTGGGTCCGACA<br>GGCCCCTGGCAAAGGACTTGAATGGGTGTCCGCCATCAACTGGAATGGCGGCTCTACA<br>GGCTACGCCGACTCTGTGAAGGGCAGATTCACCATCAGCCGGGACAACAGCAAGAAC<br>ACCCTGTACCTGCAGATGAACTCCCTGAGAGCCGAGGACACCGCCGTGTACTATTGT<br>CCAGAGGCCACCACAGCGGCTACGACGGCAGATTCTTTGACTATTGGGGCCAGGGCA<br>CCCTGGTCACAGTTTCTTCAGCCAGCACCAAGGGCCCAGCTGTGTTCCCTCTGGCCCCT<br>AGCAGCAAGAGCACATCTGGCGGAACAGCCGCCCTGGGCTGCCTCGTGAAGGACTAC<br>TTTCCCGAGCCCGTGACCGTGTCCTGGAACTCTGGCGCTCTGACAAGCGGCGTGCACA<br>CCTTTCCAGCCGTGCTGCAGAGCAGCGGCCTGTACTCTCTGAGCAGCGTCGTGACAGT<br>GCCCAGCAGCTCTCTGGGCACCCAGACCTACATCTGCAACGTGAACCACAAGCCCAGC<br>AACACCAAGGTGGACAAGAAGGTGGAACCCAAGAGCTGCGACAAGACCCACACCTGT<br>CCCCCTTGTCCTGCCCCCGAACTGCTGGGAGGCCCTTCCGTGTTCCTGTTCCCCCCAAA<br>GCCCAAGGACACCCTGATGATCAGCCGGACCCCCGAAGTGACCTGCGTGGTGGTGGA<br>TGTGTCCCACGAGGACCCTGAAGTGAAGTTCAATTGGTACGTGGACGGCGTGGAAGT<br>GCACAACGCCAAGACCAAGCCTAGAGAGGAACAGTACAACAGCACCTACCGGGTGGT<br>GTCCGTGCTGACAGTGCTGCACCAGGACTGGCTGAACGGCAAAGAGTACAAGTGCAA<br>GGTGTCCAACAAGGCCCTGCCTGCCCCCATCGAGAAAACCATCAGCAAGGCCAAGGG<br>CCAGCCCCGCGAACCCCAGGTGTACACACTGCCCCCAAGCAGGGACGAGCTGACCAA<br>GAACCAGGTGTCCCTGACCTGTCTCGTGAAAGGCTTCTACCCCTCCGATATCGCCGTG<br>GAATGGGAGAGCAACGGCCAGCCCGAGAACAACTACAAGACCACCCCCCCTGTGCTG<br>GACAGCGACGGCTCATTCTTCCTGTACAGCAAGCTGACCGTGGACAAGTCCCGGTGGC<br>AGCAGGGCAACGTGTTCAGCTGCAGCGTGATGCACGAGGCCCTGCACAACCACTACA<br>CCCAGAAGTCCCTGAGCCTGAGCCCTGGCAAG |
| 965 | CAGTCTGTTCTGACACAGCCTCCTAGCGCCTCTGGCACACCTGGACAGAGAGTGACCA<br>TCAGCTGTACCGGCAGCAGCTCCAATATCGGAGCCGGCTACAACGTGCACTGGTATCA<br>GCAGCTGCCTGGCACAGCCCCTAAACTGCTGATCTACACCAACAACAGACGGCCCAG<br>CGGCGTGCCCGATAGATTTTCTGGCAGCAAGAGCGGCACAAGCGCCAGCCTGGCTATC<br>TCTGGACTGAGATCTGAGGACGAGGCCGACTACTATTGCGCCGCCTGGGATGCTTCTC<br>TGAGCGGATGGGTTTTCGGCGGAGGCACCAAACTGACAGTGCTAGGCCAGCCTAAAG<br>CCGCCCCTAGCGTGACCCTGTTCCCTCCAAGCAGCGAGGAACTGCAGGCCAACAAGG<br>CCACCCTCGTGTGCCTGATCAGCGACTTCTATCCTGGCGCCGTGACCGTGGCCTGGAA<br>GGCCGATAGCTCTCCTGTGAAGGCCGGCGTGGAAACCACCACCCCTAGCAAGCAGAG<br>CAACAACAAATACGCCGCCAGCAGCTACCTGAGCCTGACCCCCGAGCAGTGGAAGTC |

| ANTIBODY SEQUENCES |
|---|
| SEQ ID Sequence |
| CCACAGATCCTACAGCTGCCAAGTGACCCACGAGGGCAGCACCGTGGAAAAGACAGT GGCCCCTACCGAGTGCAGC |

EXEMPLARY EMBODIMENTS

Exemplary embodiments provided in accordance with the presently disclosed subject matter include, but are not limited to, the claims and the following embodiments:

1. An isolated polypeptide or conjugate thereof, wherein the isolated polypeptide comprises the tyrosine rich domain (TRD) of a seven transmembrane receptor, further characterized in that at least 25%, at least 50%, or at least 75% of the tyrosine residues of the TRD are sulfated.
2. The isolated polypeptide or conjugate according to embodiment 1, wherein the seven transmembrane receptor is human, cynomolgus and/or mouse.
3. The isolated polypeptide or conjugate according to embodiment 1 or 2, wherein the seven transmembrane receptor is a chemokine receptor, preferably
    a. a CC chemokine receptor such as CCR1, CCR2, CCR3, CCR4, CCR5, CCR6, CCR7, CCR8, CCR9 or CCR10,
    b. a CXC chemokine receptor such as CXCR1, CXCR2, CXCR3, CXCR4, CXCR5, or CXCR6, or CX3CR1 or CXCR1.
4. The isolated polypeptide or conjugate according to any of embodiments 1 to 3, wherein the seven transmembrane receptor is CCR8.
5. The isolated polypeptide or conjugate according to any of embodiments 1 to 4, wherein the isolated polypeptide comprises the N terminus of the seven transmembrane receptor including a TRD and a LID domain, preferably wherein at least one cysteine between the TRD and the LID domain has been removed or has been altered into a different amino acid.
6. The isolated polypeptide or conjugate according to any of embodiments 1 to 5, wherein the polypeptide comprises a sequence according to or having at least 90% sequence identity with
    a. SEQ ID NO:43, SEQ ID NO:44, SEQ ID NO:46 or SEQ ID NO:47, preferably wherein at least two or all of Y3, Y15 and Y17 have been sulfated, or
    b. SEQ ID NO:45 or SEQ ID NO:48, preferably wherein at least two or all of Y3, Y14 and Y15 have been sulfated, or
    c. SEQ ID NO:1, SEQ ID NO:4, SEQ ID NO:2, SEQ ID NO:5, SEQ ID NO:3 or SEQ ID NO:6, preferably wherein at least Y10 and/or Y18 have been sulfated, or
    d. SEQ ID NO:7, SEQ ID NO:10, SEQ ID NO:8 or SEQ ID NO:11, preferably wherein at least Y26 has been sulfated, or
    e. SEQ ID NO:9 or SEQ ID NO:12, preferably wherein at least Y37 and/or Y39 has been sulfated, or
    f. SEQ ID NO:13 or SEQ ID NO:16, preferably wherein Y16 and/or Y17 have been sulfated, or
    g. SEQ ID NO:14 or SEQ ID NO:17, preferably wherein Y16 has been sulfated, or
    h. SEQ ID NO:15 or SEQ ID NO:18 preferably wherein Y20 and/or Y22 has been sulfated, or
    i. SEQ ID NO:19, SEQ ID NO:22, SEQ ID NO:20, SEQ ID NO:23, SEQ ID NO:21 or SEQ ID NO:24, preferably wherein at least Y22 has been sulfated and preferably furthermore Y16, Y19 and/or Y20 have been sulfated, or
    j. SEQ ID NO:25, SEQ ID NO:28, SEQ ID NO:26 or SEQ ID NO:29, preferably wherein two, three or all of Y3, Y10, Y14 and Y15 have been sulfated, or
    k. SEQ ID NO:27 or SEQ ID NO:30, preferably wherein two or three of Y10, Y12 and Y16 have been sulfated, or
    l. SEQ ID NO:31 or SEQ ID NO:34, preferably wherein at least two or three of Y18, Y26 and Y27 have been sulfated, or
    m. SEQ ID NO:32 or SEQ ID NO:35, preferably wherein at least two or three of Y23, Y31 and Y32 have been sulfated, or
    n. SEQ ID NO:33 or SEQ ID NO:36, preferably wherein at least two or three of Y13, Y18 and Y19 have been sulfated, or
    o. SEQ ID NO:37, SEQ ID NO:40, SEQ ID NO:38 or SEQ ID NO:41, preferably wherein one or both of Y8 and Y17 have been sulfated, or
    p. SEQ ID NO:39 or SEQ ID NO:42, preferably wherein one or both of Y8 and Y17 and optionally Y20 have been sulfated, or
    q. SEQ ID NO:61, SEQ ID NO:64, SEQ ID NO:62 or SEQ ID NO:65, preferably wherein at least Y28, and preferably also Y17 and/or Y37 has been sulfated, or
    r. SEQ ID NO:63 or SEQ ID NO:66, preferably wherein at least Y28 has been sulfated, and preferably also Y19 has been sulfated, or
    s. SEQ ID NO:67, SEQ ID NO:70, SEQ ID NO:68 or SEQ ID NO:71, preferably wherein at least one or both of Y14 and Y22 has been sulfated, or
    t. SEQ ID NO:69 or SEQ ID NO:72, preferably wherein at least one, two or all of Y14, Y17 and Y22 have been sulfated, or
    u. SEQ ID NO:73 or SEQ ID NO:76, preferably wherein Y27 has been sulfated, or
    v. SEQ ID NO:74 or SEQ ID NO:77, preferably wherein at least one of Y14 and Y28 has been sulfated, or
    w. SEQ ID NO:75 or SEQ ID NO:78, preferably wherein at least Y6 has been sulfated, or
    x. SEQ ID NO:79 or SEQ ID NO:82, preferably wherein Y23 and/or Y25 have been sulfated, or
    y. SEQ ID NO:80 or SEQ ID NO:83, preferably wherein Y20 and/or Y22 have been sulfated, or
    z. SEQ ID NO:81 or SEQ ID NO:84, preferably wherein Y24 has been sulfated, or
    aa. SEQ ID NO:85, SEQ ID NO:88, SEQ ID NO:86, SEQ ID NO:89, SEQ ID NO:87 or SEQ ID NO:90, preferably wherein at least one or both of Y27 and Y29 have been sulfated, or bb. SEQ ID NO:91, SEQ ID NO:94, SEQ ID NO:92 or SEQ ID NO:95, preferably wherein at least Y12 and/or Y21 have been sulfated, or cc. SEQ ID NO:93 or SEQ ID NO:96, preferably wherein at least Y23 and/or Y14 have been sulfated, or dd. SEQ ID NO:97, SEQ ID NO:100, SEQ ID NO:98 or SEQ ID NO:101, preferably wherein at least one of Y3 and Y27 have been sulfated, or ee. SEQ ID NO:99 or SEQ ID NO:102, preferably wherein at least Y3 and/or Y14 and/or Y20 and/or Y26 have been sulfated, or ff. SEQ ID NO:103 or SEQ ID NO:106, preferably wherein at least one or both of Y6 and Y10 have been sulfated, or gg. SEQ ID NO:104 or SEQ ID NO:107, preferably wherein at least two or all of Y4, Y7 and Y39 have been sulfated, or hh. SEQ ID NO:105 or SEQ ID NO:108, preferably wherein at least one or both of Y11 and Y15 have been sulfated, or ii. SEQ ID NO:157 or SEQ ID NO:160, preferably wherein at least Y14 has been sulfated, or jj. SEQ ID NO:158, preferably wherein at least Y20 has been sulfated, or kk. SEQ ID NO:161, preferably wherein at least Y20 or Y22 has been sulfated, or ll. SEQ ID NO:159 or SEQ ID NO:162, preferably wherein at least Y15 has been sulfated, or mm. SEQ ID NO:163 or SEQ ID NO:166, preferably wherein at least Y27 has been sulfated, or nn. SEQ ID NO:164, preferably wherein at least Y14 has been sulfated or oo. SEQ ID NO:167, preferably wherein at least Y14 or Y28 has been sulfated, or pp. SEQ ID NO:165 or SEQ ID NO:168, preferably wherein at least Y6 has been sulfated.

7. The isolated polypeptide according to any of embodiments 1 to 6, wherein the isolated polypeptide is immobilized.

8. A method for production of the isolated polypeptide or conjugate according to any of embodiments 1 to 7, wherein the method comprises synthesis of the isolated polypeptide and sulfation of the respective tyrosine residues.

9. Use of the isolated polypeptide or conjugate according to any of embodiments 1 to 7
   a. for antibody generation, preferably for the generation of a fully human antibody,
   b. as antigen or for off-target panning, and/or
   c. for characterization of an antibody.

10. A method for obtaining an antibody or binder, the method comprising the use of the isolated polypeptide or conjugate according to any of embodiments 1 to 7.

11. The method according to embodiment 10, furthermore comprising the use of at least one further isolated polypeptide or conjugate thereof, wherein the at least one further isolated polypeptide comprises a TRD
   a. of a seven transmembrane receptor different from said first seven transmembrane receptor, or
   b. of the first seven transmembrane receptor derived from a different species, preferably wherein the at least one further isolated polypeptide is an isolated polypeptide according to any of embodiments 1 to 7.

12. A method for obtaining an antibody or antibody fragment which specifically binds to a human and/or cynomolgus and/or murine CC or CXC chemokine receptor, the method comprising
   a. synthetically sulfating a polypeptide comprising a tyrosine rich domain (TRD) and
   b. selection of an antibody, antibody fragment or binder recognizing the sulfated polypeptide, and
   c. optionally producing the antibody, antibody fragment or binder.

13. The use or method according to any of embodiments 8 to 12, wherein the antibody
   a. comprises human derived CDRs, and/or
   b. is a human, rat or murine IgG antibody, preferably a human IgG1 antibody or a murine IgG2a antibody, and/or
   c. is cross reactive for two different seven transmembrane receptors, and/or
   d. is cross reactive for a human and a cynomolgus seven transmembrane receptor, and/or
   e. is characterized by a HCDR3 region comprising between 10 and 34% of tyrosine and/or between 2 and 20% of histidine, and/or
   f. does not modulate G protein independent signaling of the chemokine receptor, and/or
   g. is a non-internalizing antibody or is characterized by an internalization into a cell with endogenous target expression which is lower than the 1.5, 2, 3, 4, 5, 6, 7, or 10-fold of the internalization of the isotype control.

14. An isolated antibody, antigen-binding fragment thereof or binder obtained with a method or use according to any of embodiments 8 to 13.

15. An isolated antibody or antigen-binding fragment thereof, specifically binding to a first isolated sulfated polypeptide which comprises the tyrosine rich domain (TRD) of a seven transmembrane receptor, and optionally its LID domain, wherein at least 25%, at least 50% or at least 75% of the tyrosine residues of the TRD are sulfated.

16. The isolated antibody or antigen-binding fragment according to embodiment 15, wherein the cysteine between the TRD and the LID domain has been removed or has been exchanged into a different amino acid.

17. The isolated antibody or antigen-binding fragment according to embodiment 15 or 16, wherein the seven transmembrane receptor is a human, cynomolgus or mouse seven transmembrane receptor.

18. The isolated antibody or antigen-binding fragment according to any of embodiments 15, 16 or 17, wherein the seven transmembrane receptor is
   a. a CC chemokine receptor, preferably CCR1, CCR2, CCR3, CCR4, CCR5, CCR6, CCR7, CCR8, CCR9 or CCR10,
   b. a CXC chemokine receptor, preferably CXCR1, CXCR2, CXCR3, CXCR4, CXCR5, or CXCR6, or
   c. CX3CR1 or CXCR1.

19. An isolated antibody or antigen-binding fragment according to any of embodiments 15 to 18, said first isolated sulfated polypeptide comprising a sequence according to
   a. SEQ ID NO:1, SEQ ID NO:4, SEQ ID NO:2, SEQ ID NO:5, SEQ ID NO:3 or SEQ ID NO:6, preferably wherein at least Y10 and/or Y18 have been sulfated, or b. SEQ ID NO:7, SEQ ID NO:10, SEQ ID NO:8 or SEQ ID NO:11, preferably wherein at least Y26 has been sulfated, or
c. SEQ ID NO:9 or SEQ ID NO:12, preferably wherein at least Y37 and/or Y39 has been sulfated, or
d. SEQ ID NO:13 or SEQ ID NO:16, preferably wherein Y16 and/or Y17 have been sulfated, or
e. SEQ ID NO:14 or SEQ ID NO:17, preferably wherein Y16 has been sulfated, or
f. SEQ ID NO:15 or SEQ ID NO:18 preferably wherein Y20 and/or Y22 have been sulfated, or
g. SEQ ID NO:19, SEQ ID NO:22, SEQ ID NO:20, SEQ ID NO:23, SEQ ID NO:21 or SEQ ID NO:24, preferably wherein at least Y22 has been sulfated and preferably furthermore Y16, Y19 and/or Y20 have been sulfated, or
h. SEQ ID NO:25, SEQ ID NO:28, SEQ ID NO:26 or SEQ ID NO:29, preferably wherein two, three or all of Y3, Y10, Y14 and Y15 have been sulfated, or
i. SEQ ID NO:27 or SEQ ID NO:30, preferably wherein two or three of Y10, Y12 and Y16 have been sulfated, or
j. SEQ ID NO:31 or SEQ ID NO:34, preferably wherein at least two or three of Y18, Y26 and Y27 have been sulfated, or
k. SEQ ID NO:32 or SEQ ID NO:35, preferably wherein at least two or three of Y23, Y31 and Y32 have been sulfated, or
l. SEQ ID NO:33 or SEQ ID NO:36, preferably wherein at least two or three of Y13, Y18 and Y19 have been sulfated, or
m. SEQ ID NO:37, SEQ ID NO:40, SEQ ID NO:38 or SEQ ID NO:41, preferably wherein one or both of Y8 and Y17 have been sulfated, or
n. SEQ ID NO:39 or SEQ ID NO:42, preferably wherein one or both of Y8 and Y17 and optionally Y20 have been sulfated, or
o. SEQ ID NO:43, SEQ ID NO:44, SEQ ID NO:46 or SEQ ID NO:47, preferably wherein at least two or all of Y3, Y15 and Y17 have been sulfated, or
p. SEQ ID NO:45 or SEQ ID NO:48, preferably wherein at least two or all of Y3, Y14 and Y15 have been sulfated, or
q. SEQ ID NO:61, SEQ ID NO:64, SEQ ID NO:62 or SEQ ID NO:65, preferably wherein at least Y28, and preferably also Y17 and/or Y37 has been sulfated, or
r. SEQ ID NO:63 or SEQ ID NO:66, preferably wherein at least Y28 has been sulfated, and preferably also Y19 has been sulfated, or
s. SEQ ID NO:67, SEQ ID NO:70, SEQ ID NO:68 or SEQ ID NO:71, preferably wherein at least one or both of Y14 and Y22 has been sulfated, or
t. SEQ ID NO:69 or SEQ ID NO:72, preferably wherein at least one, two or all of Y14, Y17 and Y22 has been sulfated, or
u. SEQ ID NO:73 or SEQ ID NO:76, preferably wherein Y27 has been sulfated, or
v. SEQ ID NO:74 or SEQ ID NO:77, preferably wherein at least one of Y14 and Y28 has been sulfated, or
w. SEQ ID NO:75 or SEQ ID NO:78, preferably wherein at least Y6 has been sulfated, or
x. SEQ ID NO:79 or SEQ ID NO:82, preferably wherein Y23 and/or Y25 have been sulfated, or
y. SEQ ID NO:80 or SEQ ID NO:83, preferably wherein Y20 and/or Y22 have been sulfated, or
z. SEQ ID NO:81 or SEQ ID NO:84, preferably wherein Y24 has been sulfated, or
aa. SEQ ID NO:85, SEQ ID NO:88, SEQ ID NO:86, SEQ ID NO:89, SEQ ID NO:87 or SEQ ID NO:90, preferably wherein at least one or both of Y27 and Y29 have been sulfated, or
bb. SEQ ID NO:91, SEQ ID NO:94, SEQ ID NO:92 or SEQ ID NO:95, preferably wherein at least Y12 and/or Y21 have been sulfated, or
cc. SEQ ID NO:93 or SEQ ID NO:96, preferably wherein at least Y23 and/or Y14 have been sulfated, or
dd. SEQ ID NO:97, SEQ ID NO:100, SEQ ID NO:98 or SEQ ID NO:101, preferably wherein at least one of Y3 and Y27 have been sulfated, or
ee. SEQ ID NO:99 or SEQ ID NO:102, preferably wherein at least Y3 and/or Y14 and/or Y20 and/or Y26 have been sulfated, or
ff. SEQ ID NO:103 or SEQ ID NO:106, preferably wherein at least one or both of Y6 and Y10 has been sulfated, or
gg. SEQ ID NO:104 or SEQ ID NO:107, preferably wherein at least two or all of Y4, Y7 and Y39 have been sulfated, or
hh. SEQ ID NO:105 or SEQ ID NO:108, preferably wherein at least one or both of Y11 and Y15 have been sulfated, or
ii. SEQ ID NO:157 or SEQ ID NO:160, preferably wherein at least Y14 has been sulfated, or
jj. SEQ ID NO:158, preferably wherein at least Y20 has been sulfated, or
kk. SEQ ID NO:161, preferably wherein at least Y20 or Y22 has been sulfated, or
ll. SEQ ID NO:159 or SEQ ID NO:162, preferably wherein at least Y15 has been sulfated, or
mm. SEQ ID NO:163 or SEQ ID NO:166, preferably wherein at least Y27 has been sulfated, or
nn. SEQ ID NO:164, preferably wherein at least Y14 has been sulfated or
oo. SEQ ID NO:167, preferably wherein at least Y14 or Y28 has been sulfated, or
pp. SEQ ID NO:165 or SEQ ID NO:168, preferably wherein at least Y6 has been sulfated.

20. The isolated antibody or antigen-binding fragment according to any of embodiments 15 to 19, wherein the dissociation constant or the EC50 of the antibody for binding the first isolated sulfated polypeptide and/or for said seven transmembrane receptor is below 150 nM, 100 nM, 10 nM, 5 nM, 2.5 nM, 1 nM, 0.5 or 0.25 nM.

21. An isolated antibody or antigen-binding fragment according to any of embodiments 15 to 20, wherein the isolated antibody or antigen-binding fragment specifically binds to a second isolated sulfated polypeptide which comprises the TRD of a seven transmembrane receptor, preferably wherein the seven transmembrane receptor of the TRD comprised by the second isolated sulfated polypeptide
a. is different from the seven transmembrane receptor of the TRD comprised by the first isolated sulfated polypeptide, or
b. is the corresponding seven transmembrane receptor of the TRD comprised by the first isolated sulfated polypeptide but from a different species.

22. The isolated antibody or antigen-binding fragment according to embodiment 21, wherein the dissociation constant or the EC50 of the antibody for binding the second isolated sulfated polypeptide and/or for binding the second seven transmembrane receptor is below 10 nM, 5 nM, 2.5 nM, 1 nM, 0.5 or 0.25 nM.

23. An isolated antibody or antigen-binding fragment according to any of embodiments 15 to 22, wherein the dissociation constant (KD) of the antibody for binding the first isolated sulfated polypeptide is lower than the dissociation constant (KD) of the antibody for binding a first isolated non-sulfated polypeptide having the same sequence as the first isolated sulfated polypeptide.

24. The isolated antibody or antigen-binding fragment according to embodiment 23, wherein the dissociation constant and/or EC50 of the antibody for binding the first isolated non-sulfated polypeptide is higher than 150 nM, 250 nM, 500 nM, 1 µM, 2 µM or 3 µM, or is not detectable.

25. The isolated antibody or antigen-binding fragment according to any of embodiments 23 or 24, wherein the dissociation constant or the EC50 of the antibody or fragment for binding the first isolated sulfated polypeptide is below 10 nM, 5 nM, 2.5 nM, 1 nM, 0.5 nM or 0.25 nM, and wherein the dissociation constant of the antibody or fragment for binding the first isolated non-sulfated polypeptide is higher than 10 nM, 25 nM, 50 nM, 100 nM, 250 nM or 500 nM, or is not detectable.

26. The isolated antibody or antigen-binding fragment according to any of embodiments 15 to 25, wherein the antibody comprises human, rat or mouse derived CDRs.

27. The isolated antibody or antigen-binding fragment according to any of embodiments 15 to 26, wherein the antibody
   i. comprises human derived CDRs, and/or
   j. is cross reactive for human and cynomolgus, and/or
   k. is characterized by a HCDR3 region comprising between 10 and 34% of tyrosine and/or between 2 and 20% of histidine, and/or
   l. does not modulate G protein independent signaling of the seven transmembrane receptor, and/or
   m. is a non-internalizing antibody or is characterized by an internalization into a cell with endogenous target expression which is lower than the 1.5, 2, 3, 4, 5, 6, 7, or 10-fold of the internalization of the isotype control, and/or
   n. induces ADCC and/or ADCP
   o. is a human, rat or murine IgG antibody, preferably a human IgG1 antibody or a murine IgG2a antibody, and/or
   p. is an scFv, Fab, Fab' or a F(ab')2 fragment.

28. A conjugate comprising an antibody or antigen-binding fragment according to any of embodiments 15 to 27, preferably wherein the conjugate comprises
   e. a radioactive element,
   f. a cytotoxic agent, such as an auristatin, a maytansinoid, a kinesin-spindle protein inhibitor, a nicotinamide phosphoribosyltransferase inhibitor or a pyrrolobenzodiazepine derivative,
   g. a further antibody or antigen-binding fragment, or
   h. a chimeric antigen receptor.

29. An antibody or antigen-binding fragment according to any of embodiments 15 to 27 or a conjugate according to embodiment 28 for use in the treatment of a tumor or a disease characterized by the involvement of cells expressing the seven transmembrane receptor, optionally in combination with an antibody targeting a checkpoint inhibitor.

30. The antibody or antigen-binding fragment according to any of embodiments 15 to 27 or a conjugate according to embodiment 28 for use as a diagnostic agent in vivo or in vitro.

31. A kit comprising an antibody or antigen-binding fragment according to any of embodiments 15 to 27 or a conjugate according to embodiment 28 with instructions for use.

32. An isolated antibody or antigen-binding fragment thereof specifically binding to CCR8, wherein the antibody or antigen-binding fragment is non-internalizing or is characterized by an internalization into a cell with endogenous target expression which is lower than the 1.5, 2, 3, 4, 5, 6, 7, or 10-fold of the internalization of the isotype control.

33. An isolated antibody or antigen-binding fragment thereof, specifically binding to CCR8, wherein the antibody or fragment is characterized by a HCDR3 region comprising between 10 and 34% of tyrosine and between 2 and 20% of histidine.

34. An isolated antibody or antigen-binding fragment thereof specifically binding to CCR8, wherein the antibody comprises human derived CDRs.

35. An isolated antibody or antigen-binding fragment thereof specifically binding to CCR8, wherein the antibody or antigen-binding fragment is cross reactive for CCR8 from at least two species, preferably selected from human, cynomolgus and mouse, most preferably wherein the antibody or antigen-binding fragment is cross reactive for human and cynomolgus CCR8.

36. An isolated antibody or antigen-binding fragment thereof, specifically binding to CCR8, wherein the antibody or antigen-binding fragment,
   d. does not block CCL1 induced β-arrestin signaling and/or
   e. does not induce ERK1/2 phosphorylation and/or
   f. does not induce AKT phosphorylation.

37. An isolated antibody or antigen-binding fragment thereof specifically binding to CCR8, wherein the antibody or antigen-binding fragment is afucosylated and
   d. induces antibody-dependent cell-mediated cytotoxicity (ADCC) in target cells expressing human CCR8 via human effector cells, such as human NK cells, and
   e. induces antibody-dependent cell-mediated phagocytosis (ADCP) in target cells expressing human CCR8 via human effector cells, such as human macrophages,
   f. wherein the maximal ADCC and ADCP induced in vitro depletion of target cells expressing human CCR8 is at least 30%, 35%, 40%, 45%, 50%, 55%, 60%, 70%, 80%, 90%, 95% or 99%.

38. The isolated antibody or antigen-binding fragment according to any of embodiments 33 to 37, wherein the antibody or antigen-binding fragment is non-internalizing or is characterized by an internalization into a cell with endogenous target expression which is lower than the 1.5, 2, 3, 4, 5, 6, 7, or 10-fold of the internalization of the isotype control.

39. The isolated antibody or antigen-binding fragment according to any of embodiments 32, or 34 to 38, wherein the antibody or antigen-binding fragment is characterized by a HCDR3 region comprising between 10 and 34% of tyrosine and/or between 2 and 20% of histidine.

40. The isolated antibody or antigen-binding fragment according to any of embodiments 32 to 33, or 35 to 39, wherein the antibody comprises human derived CDRs.
41. The isolated antibody or antigen-binding fragment according to any of embodiments 32 to 34, or 36 to 40, wherein the antibody or antigen-binding fragment is cross reactive for CCR8 from at least two species, preferably selected from human, cynomolgus and mouse, most preferably wherein the antibody or antigen-binding fragment is cross reactive for human and cynomolgus CCR8.
42. The isolated antibody or antigen-binding fragment according to any of embodiments 32 to 41, wherein the antibody or antigen-binding fragment binds the CCR8 from a first species with a first dissociation constant KD and binds the CCR8 from a second species with a second dissociation constant KD, wherein the first and the second dissociation constant are in the same order of magnitude.
43. The isolated antibody or antigen-binding fragment according to any of embodiments 32 to 35, or 37 to 42, wherein the antibody or antigen-binding fragment,
    d. does not block CCL1 induced β-arrestin signaling and/or
    e. does not induce ERK1/2 phosphorylation and/or
    f. does not induce AKT phosphorylation.
44. The isolated antibody or antigen-binding fragment according to any of embodiments 32 to 36, or 38 to 43, wherein the antibody or antigen-binding fragment
    d. induces antibody-dependent cell-mediated cytotoxicity (ADCC) in target cells expressing human CCR8 via human effector cells, such as human NK cells, and
    e. induces antibody-dependent cell-mediated phagocytosis (ADCP) in target cells expressing human CCR8 via human effector cells, such as human macrophages, and optionally
    f. wherein the maximal ADCC and ADCP induced in vitro depletion of target cells expressing human CCR8 is at least 30%, 35%, 40%, 45%, 50%, 55%, 60%, 70%, 80%, 90%, 95% or 99%.
45. The isolated antibody or antigen-binding fragment according to any of embodiments 32 to 44, wherein the antibody or antigen-binding fragment specifically binds to the sulfated tyrosine rich domain of CCR8.
46. The isolated antibody or antigen-binding fragment according to any of embodiments 32 to 45, wherein the antibody or antigen-binding fragment specifically binds
    (i) with an EC50 of <15 nM, <10 nM, <5 nM, <1 nM or <0.6 nM
        a. to human CCR8 and/or to an isolated polypeptide according to SEQ ID NO:46, wherein at least two or all of Y3, Y15 and Y17 have been sulfated, and/or
        b. to cynomolgus CCR8 and/or to an isolated polypeptide according to SEQ ID NO:47, wherein at least two or all of Y3, Y15 and Y17 have been sulfated, and/or
        c. to murine CCR8 and/or to an isolated polypeptide according to SEQ ID NO:48, wherein at least two or all of Y3, Y14 and Y15 have been sulfated, and/or
    (ii) with an EC50 of <50 nM, <25 nM, <15 nM or <10 nM to activated human regulatory T cells.
47. The isolated antibody or antigen-binding fragment thereof according to any of embodiments 32 to 46,
    c. wherein the antibody or antigen-binding fragment binds to human Fc gamma receptor IIIA variant V176 (CD16a) with a dissociation constant (KD) lower than 530 nM, 500 nM, 450 nM, 400 nM, 300 nM or 200 nM, and/or
    d. wherein the antibody or antigen-binding fragment binds to human Fc gamma RIIA (CD32a) with a dissociation constant (KD) lower than 30 µM, 20 µM, 10 µM, 5 µM or 1 µM.
48. The isolated antibody or antigen-binding fragment thereof according to any of embodiments 32 to 47, wherein the antibody or antigen-binding fragment is afucosylated.
49. The isolated antibody or antigen-binding fragment thereof according to any of embodiments 32 to 48, wherein the antibody or antigen-binding fragment
    f. induces antibody-dependent cell-mediated cytotoxicity (ADCC) in target cells expressing human CCR8 via human effector cells, such as human NK cells, and/or
    g. induces antibody-dependent cell-mediated phagocytosis (ADCP) in target cells expressing human CCR8 via human effector cells, such as human macrophages, preferably, wherein
    h. the ADCC-induced maximal depletion of activated human regulatory T cells is at least 25%, 30%, 35%, 40%, 45%, 50%, 55%, 60%, 70%, 80%, 90%, 95%, 98% or 99%, and/or
    i. the ADCP-induced maximal depletion of activated human regulatory T cells is at least 5%, 10%, 15%, 20%, 25%, 30%, 40% or 50%, and/or
    j. the maximal ADCC and ADCP induced in vitro depletion of activated human regulatory T cells is at least 30%, 35%, 40%, 45%, 50%, 55%, 60%, 70%, 80%, 90%, 95% or 99%.
50. The isolated antibody or antigen-binding fragment according to any of embodiments 32 to 49, wherein
    c. the EC50 of the antibody or antigen-binding fragment for ADCC-induced depletion of activated human regulatory T cells is below 100 pM, 50 pM, 25 pM, 12.5 pM, 10 pM or 5 pM and/or
    d. the EC50 of the antibody or antigen-binding fragment for ADCP-induced depletion of activated human regulatory T cells is below 500 pM, 250 pM, 200 pM, 150 pM, 100 pM, 75 pM, 50 pM or 25 pM.
51. The isolated antibody or antigen-binding fragment according to any of embodiments 32 to 50, wherein an effective dose of the antibody or antigen-binding fragment
    d. decreases the number of activated or intra-tumoral regulatory T cells, in vitro or in a subject, to less than 50%, 40%, 30%, 25%, 20%, 10%, 5% or 1% and/or
    e. increases the ratio of intra-tumoral CD8+ T cells to intra-tumoral Tregs, in vitro or in a subject, to at least 5, 10, 15, 20, 25, 30, 40, 50, 60, 70, 80, 90, 100, 150, 200, or higher and/or
    f. decreases the percentage of regulatory T cells of intra-tumoral CD4+ T cells, in vitro or in a subject, to <30%, <20%, <10% or <5%.
52. The isolated antibody or antigen-binding fragment according to any of embodiments 32 to 51, wherein an effective dose of the antibody or antigen-binding fragment induces formation of tertiary lymphoid structures in a tumor.
53. The isolated antibody or antigen-binding fragment thereof according to any of embodiments 32 to 52, wherein the antibody is an IgG antibody, preferably a human IgG1 or a murine IgG2a, and or wherein the antigen-binding fragment is an scFv, Fab, Fab' or a F(ab')2 fragment.
54. A conjugate comprising an antibody or antigen-binding fragment according to any of embodiments 32 to 53, preferably wherein the conjugate comprises
    f. a radioactive element,
    g. a cytotoxic agent, such as an auristatin, a maytansinoid, a kinesin-spindle protein inhibitor, a nicotinamide phosphoribosyltransferase inhibitor or a pyrrolobenzodiazepine derivative,
    h. a further antibody or antigen-binding fragment, or
    i. a chimeric antigen receptor.
55. A pharmaceutical composition comprising an antibody or antigen-binding fragment according to any of embodiments 32 to 53 or a conjugate according to embodiment 54.
56. The pharmaceutical composition according to embodiment 55, comprising one or more further therapeutically active compounds, preferably selected from
    g. an antibody or compound targeting a checkpoint protein, such as PD1, PD-L1 or CTLA-4, preferably wherein the antibody or compound targeting the checkpoint protein is Nivolumab, Pembrolizumab, Atezolizumab, Avelumab, Durvalumab, Cemiplimab, Dostarlimab or Ipilimumab,
    h. an antibody targeting a further chemokine receptor, such as CCR1, CCR2, CCR3, CCR4, CCR5, CCR6, CCR7, CCR9, CCR10, CXCR1, CXCR2, CXCR3, CXCR4, CXCR5, CXCR6, CX3CR1 or CXCR1,
    i. an antibody or a small molecule targeting HER2 and/or EGFR,
    j. the standard of care for any of head and neck cancer, breast cancer, gastric cancer, lung cancer, squamous cell carcinoma and esophageal tumor, melanoma, bladder cancer, liver cancer, and/or prostate cancer,
    k. a chemotherapeutic agent, preferably a taxane, paclitaxel, doxorubicin, cis-platin, carboplatin, oxaliplatin, or gemcitabine,
    j. a B cell depleting agent, such as an anti-CD19 antibodies or an anti-CD20 antibodies and/or l. a targeted kinase inhibitor, such as Sorafinib, Regorafenib, or MEKi-1.
57. An antibody or antigen-binding fragment according to any of embodiments 32 to 53 or a conjugate according to embodiment 54 or a pharmaceutical composition according to embodiment 55 or 56 for use as a medicament.
58. The antibody or antigen-binding fragment according to any of embodiments 32 to 53 or conjugate according to embodiment 54 or pharmaceutical composition according to embodiment 55 or 56 for use in the treatment of a tumor or a disease characterized by CCR8 positive cells, such as CCR8 positive regulatory T cells.
59. An antibody or antigen-binding fragment according to any of embodiments 32 to 53 or a conjugate according to embodiment 54 or a pharmaceutical composition according to embodiment 55 or 56 for use in simultaneous, separate, or sequential combination
    (i) with one or more further therapeutically active compounds, preferably selected from
        h. an antibody or a small molecule targeting a checkpoint protein, such as PD1, PD-L1 or CTLA-4, preferably wherein the antibody or small molecule targeting a checkpoint protein is Nivolumab, Pembrolizumab, Atezolizumab, Avelumab, Durvalumab, Cemiplimab, Dostarlimab or Ipilimumab,
        i. an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
        j. an antibody targeting a protein which is specifically expressed by the tumor cells,
        k. an antibody or a small molecule targeting HER2 and/or EGFR,
        l. the standard of care for any of head and neck cancer, breast cancer, gastric cancer, lung cancer, squamous cell carcinoma, esophageal tumor, melanoma, bladder cancer, liver cancer, and/or prostate cancer,
        m. a chemotherapeutic agent, preferably a taxane, paclitaxel, doxorubicin, cis-platin, carboplatin, oxaliplatin, or gemcitabine and/or
        n. a targeted kinase inhibitor, such as Sorafinib, Regorafenib, or MEKi-1, and/or
    (ii) with radiation therapy, and/or
    (iii) with depletion of intra-tumoral B cells, in the treatment of a tumor or a disease characterized by CCR8 positive cells, such as CCR8 positive regulatory T cells.
60. The antibody, fragment, conjugate or pharmaceutical composition for use according to embodiment 58 or 59, wherein the tumor is selected from the group of T-cell acute lymphoblastic leukemia, breast cancer, triple-negative breast cancer, triple positive breast cancer, non-small cell lung cancer (NSCLC), small cell lung cancer (SCLC), testicular cancer, gastric cancer, head and neck squamous cell carcinoma, thymoma, esophageal adenocarcinoma, colorectal cancer, pancreatic adenocarcinoma, ovarian cancer or cervical cancer, acute myeloid leukemia, kidney cancer, bladder cancer, skin cancer, melanoma, thyroid cancer, mesothelioma, sarcoma and prostate cancer, B cell lymphoma, T cell lymphoma, or any other cancer involving CCR8 expressing cells, preferably wherein the tumor is selected from head and neck cancer, breast cancer, gastric cancer, lung cancer, squamous cell carcinoma, esophageal tumor, melanoma, bladder cancer, liver cancer, prostate cancer, B cell lymphoma and T cell lymphoma.
61. The antibody, fragment, conjugate or pharmaceutical composition for use according to embodiment 57 to 60, wherein the use comprises determining
    n. presence or quantity of tumor infiltrating lymphocytes,
    o. presence or quantity of macrophages and/or NK cells,
    p. presence or quantity of CCR8 positive or FOXP3 positive regulatory T cells,
    q. tumor mutational burden,
    r. cancer staging,
    s. presence, level or activation of interferon-stimulated genes or proteins,
    t. CCR8 expression,
    u. presence or quantity of complement factor proteins, serpins, and/or MHC components,
    v. presence or quantity of cytokines, such as inflammatory or suppressive cytokines,
    w. activation of immune gene expression, and/or
    x. immune checkpoint (protein) expression, such as PD-(L)1 or CTLA4 expression, y. presence or quantity of tumor infiltrating CD19+ B cells,
z. presence or quantity of tumor infiltrating CD8+ T cells to predict or monitor treatment success.
62. A polynucleotide encoding an antibody or antigen-binding fragment according to any of embodiments 32 to 53.
63. A vector comprising a polynucleotide according to embodiment 62.
64. An isolated cell arranged for production of an antibody or antigen-binding fragment according to any of embodiments 32 to 53.
65. A method of producing an antibody or antigen-binding fragment according to any of embodiments 32 to 53 or a conjugate according to embodiment 54, comprising culturing a cell according to embodiment 64 and optionally purification of the antibody or antigen-binding fragment.
66. The antibody or antigen-binding fragment according to any of embodiments 32 to 53 or a conjugate according to embodiment 54 for use as a diagnostic agent in vivo or in vitro.
67. A kit comprising an antibody or antigen-binding fragment according to any of embodiments 32 to 53 or a conjugate according to embodiment 54 or a pharmaceutical composition according to embodiment 55 or 56 with instructions for use.
68. An isolated anti-CCR8 antibody or antigen-binding fragment thereof, specifically binding with a KD value of <5E-8 M, <4E-8 M, <3E-8 M, <2E-8 M, <1E-8 M, <9E-9 M, <8E-9 M, <7E-9 M, <6E-9 M, <5E-9 M, <4E-9 M, <3E-9 M, <2.5E-9 M, <2E-9 M, <1.5E-9 M, <1E-9 M, <9E-10 M, <8E-10 M, <7E-10 M, <6E-10 M, <5E-10 M, <4E-10 M, <3E-10 M, <2.5E-10 M, <2E-10 M, <1.5E-10 M, <1E-10 M, or <9E-11 M
  a. to an isolated polypeptide according to SEQ ID NO:43 and/or SEQ ID NO:46, wherein at least two or all of Y3, Y15 and Y17 have been sulfated, and/or
  b. to an isolated polypeptide according to SEQ ID NO:44 and/or SEQ ID NO:47, wherein at least two or all of Y3, Y15 and Y17 have been sulfated, and/or
  c. to an isolated polypeptide according to SEQ ID NO:45 and/or SEQ ID NO:48, wherein at least two or all of Y3, Y14 and Y15 have been sulfated.
69. The isolated antibody or antigen-binding fragment according to embodiment 68, wherein the antibody or antigen-binding fragment is characterized by a HCDR3 region comprising between 10 and 34% of tyrosine and/or between 2 and 20% of histidine.
70. The isolated antibody or antigen-binding fragment according to embodiment 68 or 69, wherein the antibody or antigen-binding fragment comprises human derived CDRs.
71. The isolated antibody or antigen-binding fragment according to any of embodiments 68 to 70, wherein the antibody or antigen-binding fragment is cross reactive for human and cynomolgus CCR8.
72. The isolated antibody or antigen-binding fragment according to any of embodiments 68 to 71, wherein the antibody or antigen-binding fragment
  a. does not block CCL1 induced β-arrestin signaling, and/or
  b. does not induce ERK1/2 phosphorylation, and/or
  c. does not induce AKT phosphorylation.
73. The isolated antibody or antigen-binding fragment according to any of embodiments 68 to 72, wherein the antibody or antigen-binding fragment is non-internalizing or is characterized by an internalization into a cell with endogenous target expression which is lower than the 1.5, 2, 3, 4, 5, 6, 7, or 10-fold of the internalization of the isotype control.
74. The isolated antibody or antigen-binding fragment thereof according to any of embodiments 68 to 73,
  a. wherein the antibody or antigen-binding fragment binds to human Fc gamma receptor IIIA variant V176 (CD16a) with a dissociation constant (KD) lower than 530 nM, 500 nM, 450 nM, 400 nM, 300 nM or 200 nM, and/or
  b. wherein the antibody or antigen-binding fragment binds to human Fc gamma RIIA (CD32a) with a dissociation constant (KD) lower than 30 μM, 20 μM, 10 μM, 5 μM or 1 μM.
75. An isolated anti-CCR8 antibody or antigen-binding fragment thereof comprising a HCDR3 sequence having at least 90%, 95%, 98% or 100% sequence identity with any of SEQ ID NO:260 (TPP-16966), SEQ ID NO:278 (TPP-17575), SEQ ID NO:296 (TPP-17576), SEQ ID NO:314 (TPP-17577), SEQ ID NO:332 (TPP-17578), SEQ ID NO:350 (TPP-17579), SEQ ID NO:368 (TPP-17580), SEQ ID NO:386 (TPP-17581), SEQ ID NO:404 (TPP-18205), SEQ ID NO:422 (TPP-18206), SEQ ID NO:440 (TPP-18207), SEQ ID NO:458 (TPP-19546), SEQ ID NO:476 (TPP-20950), SEQ ID NO:494 (TPP-20955), SEQ ID NO:512 (TPP-20965), SEQ ID NO:530 (TPP-21045), SEQ ID NO:548 (TPP-21047), SEQ ID NO:566 (TPP-21181), SEQ ID NO:584 (TPP-21183), SEQ ID NO:602 (21360), or SEQ ID NO:620 (TPP-23411), SEQ ID NO:663 (TPP-29596), SEQ ID NO:683 (TPP-29597), SEQ ID NO:705 (TPP-18429), SEQ ID NO:725 (TPP-18430), SEQ ID NO:745 (TPP-18432), SEQ ID NO:765 (TPP-18433), SEQ ID NO:785 (TPP-18436), SEQ ID NO:805 (TPP-19571), SEQ ID NO:829 (TPP-27477), SEQ ID NO:849 (TPP-27478), SEQ ID NO:869 (TPP-27479), SEQ ID NO:889 (TPP-27480), SEQ ID NO:909 (TPP-29367), SEQ ID NO:929 (TPP-29368), or SEQ ID NO:949 (TPP-29369).
76. An isolated anti-CCR8 antibody or antigen-binding fragment thereof comprising at least one, two, three, four, five or six CDR sequence(s) having at least 90%, 95%, 98% or 100% sequence identity with any of
  a. SEQ ID NO:258, SEQ ID NO:259, SEQ ID NO:260, SEQ ID NO:262, SEQ ID NO:263 or SEQ ID NO:264 (TPP-16966),
  b. SEQ ID NO:276, SEQ ID NO:277, SEQ ID NO:278, SEQ ID NO:280, SEQ ID NO:281 or SEQ ID NO:282 (TPP-17575),
  c. SEQ ID NO:294, SEQ ID NO:295, SEQ ID NO:296, SEQ ID NO:298, SEQ ID NO:299 or SEQ ID NO:300 (TPP-17576),
  d. SEQ ID NO:312, SEQ ID NO:313, SEQ ID NO:314, SEQ ID NO:316, SEQ ID NO:317 or SEQ ID NO:318 (TPP-17577),
  e. SEQ ID NO:330, SEQ ID NO:331, SEQ ID NO:332, SEQ ID NO:334, SEQ ID NO:335 or SEQ ID NO:336 (TPP-17578),
  f. SEQ ID NO:348, SEQ ID NO:349, SEQ ID NO:350, SEQ ID NO:352, SEQ ID NO:353 or SEQ ID NO:354 (TPP-17579),
  g. SEQ ID NO:366, SEQ ID NO:367, SEQ ID NO:368, SEQ ID NO:370, SEQ ID NO:371 or SEQ ID NO:372 (TPP-17580), h. SEQ ID NO:384, SEQ ID NO:385, SEQ ID NO:386, SEQ ID NO:388, SEQ ID NO:389 or SEQ ID NO:390 (TPP-17581),
i. SEQ ID NO:402, SEQ ID NO:403, SEQ ID NO:404, SEQ ID NO:406, SEQ ID NO:407 or SEQ ID NO:408 (TPP-18205),
j. SEQ ID NO:420, SEQ ID NO:421, SEQ ID NO:422, SEQ ID NO:424, SEQ ID NO:425 or SEQ ID NO:426 (TPP-18206),
k. SEQ ID NO:438, SEQ ID NO:439, SEQ ID NO:440, SEQ ID NO:442, SEQ ID NO:443 or SEQ ID NO:444 (TPP-18207),
l. SEQ ID NO:456, SEQ ID NO:457, SEQ ID NO:458, SEQ ID NO:460, SEQ ID NO:461 or SEQ ID NO:462 (TPP-19546),
m. SEQ ID NO:474, SEQ ID NO:475, SEQ ID NO:476, SEQ ID NO:478, SEQ ID NO:479 or SEQ ID NO:480 (TPP-20950),
n. SEQ ID NO:492, SEQ ID NO:493, SEQ ID NO:494, SEQ ID NO:496, SEQ ID NO:497 or SEQ ID NO:498 (TPP-20955),
o. SEQ ID NO:510, SEQ ID NO:511, SEQ ID NO:512, SEQ ID NO:514, SEQ ID NO:515, or SEQ ID NO:516 (TPP-20965),
p. SEQ ID NO:528, SEQ ID NO:529, SEQ ID NO:530, SEQ ID NO:532, SEQ ID NO:533 or SEQ ID NO:534 (TPP-21045),
q. SEQ ID NO:546, SEQ ID NO:547, SEQ ID NO:548, SEQ ID NO:550, SEQ ID NO:551 or SEQ ID NO:552 (TPP-21047),
r. SEQ ID NO:564, SEQ ID NO:565, SEQ ID NO:566, SEQ ID NO:568, SEQ ID NO:569 or SEQ ID NO:570 (TPP-21181),
s. SEQ ID NO:582, SEQ ID NO:583, SEQ ID NO:584, SEQ ID NO:586, SEQ ID NO:587 or SEQ ID NO:588 (TPP-21183),
t. SEQ ID NO:600, SEQ ID NO:601, SEQ ID NO:602, SEQ ID NO:604, SEQ ID NO:605 SEQ ID NO:606 (TPP-21360),
u. SEQ ID NO:618, SEQ ID NO:619, SEQ ID NO:620, SEQ ID NO:622, SEQ ID NO:623 SEQ ID NO:624 (TPP-23411),
v. SEQ ID NO:661, SEQ ID NO:662, SEQ ID NO:663, SEQ ID NO:665, SEQ ID NO:666 SEQ ID NO:667 (TPP-29596),
w. SEQ ID NO:681, SEQ ID NO:682, SEQ ID NO:683, SEQ ID NO:685, SEQ ID NO:686 SEQ ID NO:687 (TPP-29597),
x. SEQ ID NO:703, SEQ ID NO:704, SEQ ID NO:705, SEQ ID NO:707, SEQ ID NO:708 SEQ ID NO:709 (TPP-18429),
y. SEQ ID NO:723, SEQ ID NO:724, SEQ ID NO:725, SEQ ID NO:727, SEQ ID NO:728 SEQ ID NO:729 (TPP-18430),
z. SEQ ID NO:743, SEQ ID NO:744, SEQ ID NO:745, SEQ ID NO:747, SEQ ID NO:748 SEQ ID NO:749 (TPP-18432),
aa. SEQ ID NO:763, SEQ ID NO:764, SEQ ID NO:765, SEQ ID NO:767, SEQ ID NO:768 SEQ ID NO:769 (TPP-18433),
bb. SEQ ID NO:783, SEQ ID NO:784, SEQ ID NO:785, SEQ ID NO:787, SEQ ID NO:788 SEQ ID NO:789 (TPP-18436),
cc. SEQ ID NO:803, SEQ ID NO:804, SEQ ID NO:805, SEQ ID NO:807, SEQ ID NO:808 SEQ ID NO:809 (TPP-19571),
dd. SEQ ID NO:827, SEQ ID NO: 828, SEQ ID NO: 829, SEQ ID NO: 831, SEQ ID NO:832 SEQ ID NO:833 (TPP-27477),
ee. SEQ ID NO:847, SEQ ID NO: 848, SEQ ID NO: 849, SEQ ID NO: 851, SEQ ID NO:852 SEQ ID NO:853 (TPP-27478),
ff. SEQ ID NO:867, SEQ ID NO: 868, SEQ ID NO: 869, SEQ ID NO: 871, SEQ ID NO:872 SEQ ID NO:873 (TPP-27479),
gg. SEQ ID NO:887, SEQ ID NO: 888, SEQ ID NO: 889, SEQ ID NO: 891, SEQ ID NO:892 SEQ ID NO:893 (TPP-27480),
hh. SEQ ID NO:907, SEQ ID NO: 908, SEQ ID NO: 909, SEQ ID NO: 911, SEQ ID NO:912 SEQ ID NO:913 (TPP-29367),
ii. SEQ ID NO:927, SEQ ID NO: 928, SEQ ID NO: 929, SEQ ID NO: 931, SEQ ID NO:932 or SEQ ID NO:933 (TPP-29368), or
jj. SEQ ID NO:947, SEQ ID NO: 948, SEQ ID NO: 949, SEQ ID NO: 951, SEQ ID NO:952 or SEQ ID NO:953 (TPP-29369),
kk. SEQ ID NO:202, SEQ ID NO:203, SEQ ID NO:204, SEQ ID NO:206, SEQ ID NO:207 and SEQ ID NO:208 (TPP-14095),
ll. SEQ ID NO:216, SEQ ID NO:217, SEQ ID NO:218, SEQ ID NO:220, SEQ ID NO:221 or SEQ ID NO:222 (TPP-14099),
mm. SEQ ID NO:230, SEQ ID NO:231, SEQ ID NO:232, SEQ ID NO:234, SEQ ID NO:235 and SEQ ID NO:236 (TPP-15285), or
nn. SEQ ID NO:244, SEQ ID NO:245, SEQ ID NO:246, SEQ ID NO:248, SEQ ID NO:249 and SEQ ID NO:250 (TPP-15286).

77. An isolated anti-CCR8 antibody or antigen-binding fragment thereof comprising a variable heavy chain sequence and/or a variable light chain sequence having at least 90%, 95%, 98% or 100% sequence identity with
a. a variable heavy chain sequence according to SEQ ID NO:257 and/or a variable light chain sequence according to SEQ ID NO:261 (TPP-16966),
b. a variable heavy chain sequence according to SEQ ID NO:275 and/or a variable light chain sequence according to SEQ ID NO:279 (TPP-17575),
c. a variable heavy chain sequence according to SEQ ID NO:293 and/or a variable light chain sequence according to SEQ ID NO:297 (TPP-17576),
d. a variable heavy chain sequence according to SEQ ID NO:311 and/or a variable light chain sequence according to SEQ ID NO:315 (TPP-17577),
e. a variable heavy chain sequence according to SEQ ID NO:329 and/or a variable light chain sequence according to SEQ ID NO:333 (TPP-17578),
f. a variable heavy chain sequence according to SEQ ID NO:347 and/or a variable light chain sequence according to SEQ ID NO:351 (TPP-17579),
g. a variable heavy chain sequence according to SEQ ID NO:365 and/or a variable light chain sequence according to SEQ ID NO:369 (TPP-17580),
h. a variable heavy chain sequence according to SEQ ID NO:383 and/or a variable light chain sequence according to SEQ ID NO:387 (TPP-17581),
i. a variable heavy chain sequence according to SEQ ID NO:401 and/or a variable light chain sequence according to SEQ ID NO:405 (TPP-18205), j. a variable heavy chain sequence according to SEQ ID NO:419 and/or a variable light chain sequence according to SEQ ID NO:423 (TPP-18206),
k. a variable heavy chain sequence according to SEQ ID NO:437 and/or a variable light chain sequence according to SEQ ID NO:441 (TPP-18207),
l. a variable heavy chain sequence according to SEQ ID NO:455 and/or a variable light chain sequence according to SEQ ID NO:459 (TPP-19546),
m. a variable heavy chain sequence according to SEQ ID NO:473 and/or a variable light chain sequence according to SEQ ID NO:477 (TPP-20950),
n. a variable heavy chain sequence according to SEQ ID NO:491 and/or a variable light chain sequence according to SEQ ID NO:495 (TPP-20955),
o. a variable heavy chain sequence according to SEQ ID NO:509 and/or a variable light chain sequence according to SEQ ID NO:513 (TPP-20965),
p. a variable heavy chain sequence according to SEQ ID NO:527 and/or a variable light chain sequence according to SEQ ID NO:531 (TPP-21045),
q. a variable heavy chain sequence according to SEQ ID NO:545 and/or a variable light chain sequence according to SEQ ID NO:549 (TPP-21047),
r. a variable heavy chain sequence according to SEQ ID NO:563 and/or a variable light chain sequence according to SEQ ID NO:567 (TPP-21181),
s. a variable heavy chain sequence according to SEQ ID NO:581 and/or a variable light chain sequence according to SEQ ID NO:585 (TPP-21183),
t. a variable heavy chain sequence according to SEQ ID NO:599 and/or a variable light chain sequence according to SEQ ID NO:603 (TPP-21360),
u. a variable heavy chain sequence according to SEQ ID NO:617 and/or a variable light chain sequence according to SEQ ID NO:621 (TPP-23411),
v. a variable heavy chain sequence according to SEQ ID NO:660 and/or a variable light chain sequence according to SEQ ID NO:664 (TPP-29596),
w. a variable heavy chain sequence according to SEQ ID NO:680 and/or a variable light chain sequence according to SEQ ID NO:684 (TPP-29597),
x. a variable heavy chain sequence according to SEQ ID NO:702 and/or a variable light chain sequence according to SEQ ID NO:706 (TPP-18429),
y. a variable heavy chain sequence according to SEQ ID NO:722 and/or a variable light chain sequence according to SEQ ID NO:726 (TPP-18430),
z. a variable heavy chain sequence according to SEQ ID NO:742 and/or a variable light chain sequence according to SEQ ID NO:746 (TPP-18432),
aa. a variable heavy chain sequence according to SEQ ID NO:762 and/or a variable light chain sequence according to SEQ ID NO:766 (TPP-18433),
bb. a variable heavy chain sequence according to SEQ ID NO:782 and/or a variable light chain sequence according to SEQ ID NO:786 (TPP-18436),
cc. a variable heavy chain sequence according to SEQ ID NO:802 and/or a variable light chain sequence according to SEQ ID NO:806 (TPP-19571),
dd. a variable heavy chain sequence according to SEQ ID NO:826 and/or a variable light chain sequence according to SEQ ID NO:830 (TPP-27477),
ee. a variable heavy chain sequence according to SEQ ID NO:846 and/or a variable light chain sequence according to SEQ ID NO:850 (TPP-27478),
ff. a variable heavy chain sequence according to SEQ ID NO:866 and/or a variable light chain sequence according to SEQ ID NO:870 (TPP-27479),
gg. a variable heavy chain sequence according to SEQ ID NO:886 and/or a variable light chain sequence according to SEQ ID NO:890 (TPP-27480),
hh. a variable heavy chain sequence according to SEQ ID NO:906 and/or a variable light chain sequence according to SEQ ID NO:910 (TPP-29367),
ii. a variable heavy chain sequence according to SEQ ID NO:926 and/or a variable light chain sequence according to SEQ ID NO:930 (TPP-29368),
jj. a variable heavy chain sequence according to SEQ ID NO:946 and/or a variable light chain sequence according to SEQ ID NO:950 (TPP-29369),
kk. a variable heavy chain sequence according to SEQ ID NO:201 and a variable light chain sequence according to SEQ ID NO:205 (TPP-14095),
ll. a variable heavy chain sequence according to SEQ ID NO:215 and a variable light chain sequence according to SEQ ID NO:219 (TPP-14099),
mm. a variable heavy chain sequence according to SEQ ID NO:229 and a variable light chain sequence according to SEQ ID NO:233 (TPP-15285), or
nn. a variable heavy chain sequence according to SEQ ID NO:243 and a variable light chain sequence according to SEQ ID NO:247 (TPP-15286).

78. An isolated anti-CCR8 antibody or antigen-binding fragment thereof comprising a heavy chain sequence and/or a light chain sequence having at least 90%, 95%, 98% or 100% sequence identity with
a. a heavy chain according to SEQ ID NO:273 and a light chain according to SEQ ID NO:274 (TPP-16966),
b. a heavy chain according to SEQ ID NO:291 and a light chain according to SEQ ID NO:292 (TPP-17575),
c. a heavy chain according to SEQ ID NO:309 and a light chain according to SEQ ID NO:310 (TPP-17576),
d. a heavy chain according to SEQ ID NO:327 and a light chain according to SEQ ID NO:328 (TPP-17577),
e. a heavy chain according to SEQ ID NO:345 and a light chain according to SEQ ID NO:346 (TPP-17578),
f. a heavy chain according to SEQ ID NO:363 and a light chain according to SEQ ID NO:364 (TPP-17579),
g. a heavy chain according to SEQ ID NO:381 and a light chain according to SEQ ID NO:382 (TPP-17580),
h. a heavy chain according to SEQ ID NO:399 and a light chain according to SEQ ID NO:400 (TPP-17581),
i. a heavy chain according to SEQ ID NO:417 and a light chain according to SEQ ID NO:418 (TPP-18205),
j. a heavy chain according to SEQ ID NO:435 and a light chain according to SEQ ID NO:436 (TPP-18206),
k. a heavy chain according to SEQ ID NO:453 and a light chain according to SEQ ID NO:454 (TPP-18207),
l. a heavy chain according to SEQ ID NO:471 and a light chain according to SEQ ID NO:472 (TPP-19546), m. a heavy chain according to SEQ ID NO:489 and a light chain according to SEQ ID NO:490 (TPP-20950),
n. a heavy chain according to SEQ ID NO:507 and a light chain according to SEQ ID NO:508 (TPP-20955),
o. a heavy chain according to SEQ ID NO:525 and a light chain according to SEQ ID NO:526 (TPP-20965),
p. a heavy chain according to SEQ ID NO:543 and a light chain according to SEQ ID NO:544 (TPP-21045),
q. a heavy chain according to SEQ ID NO:561 and a light chain according to SEQ ID NO:562 (TPP-21047),
r. a heavy chain according to SEQ ID NO:579 and a light chain according to SEQ ID NO:580 (TPP-21181),
s. a heavy chain according to SEQ ID NO:597 and a light chain according to SEQ ID NO:598 (TPP-21183),
t. a heavy chain according to SEQ ID NO:615 and a light chain according to SEQ ID NO:616 (TPP-21360),
u. a heavy chain according to SEQ ID NO:633 and a light chain according to SEQ ID NO:634 (TPP-23411),
v. a heavy chain according to SEQ ID NO:676 and a light chain according to SEQ ID NO:677 (TPP-29596),
w. a heavy chain according to SEQ ID NO:696 and a light chain according to SEQ ID NO:697 (TPP-29597),
x. a heavy chain according to SEQ ID NO:718 and a light chain according to SEQ ID NO:719 (TPP-18429),
y. a heavy chain according to SEQ ID NO:738 and a light chain according to SEQ ID NO:739 (TPP-18430),
z. a heavy chain according to SEQ ID NO:758 and a light chain according to SEQ ID NO:759 (TPP-18432),
aa. a heavy chain according to SEQ ID NO:778 and a light chain according to SEQ ID NO:779 (TPP-18433),
bb. a heavy chain according to SEQ ID NO:798 and a light chain according to SEQ ID NO:799 (TPP-18436),
cc. a heavy chain according to SEQ ID NO: 818 and a light chain according to SEQ ID NO: 819 (TPP-19571),
dd. a heavy chain according to SEQ ID NO: 842 and a light chain according to SEQ ID NO: 843 (TPP-27477),
ee. a heavy chain according to SEQ ID NO:862 and a light chain according to SEQ ID NO:863 (TPP-27478),
ff. a heavy chain according to SEQ ID NO:882 and a light chain according to SEQ ID NO:883 (TPP-27479),
gg. a heavy chain according to SEQ ID NO:902 and a light chain according to SEQ ID NO:903 (TPP-27480),
hh. a heavy chain according to SEQ ID NO:922 and a light chain according to SEQ ID NO:923 (TPP-29367),
ii. a heavy chain according to SEQ ID NO:942 and a light chain according to SEQ ID NO:943 (TPP-29368),
jj. a heavy chain according to SEQ ID NO:962 and a light chain according to SEQ ID NO:963 (TPP-29369),
kk. a heavy chain according to SEQ ID NO:211 and a light chain according to SEQ ID NO:212 (TPP-14095),
ll. a heavy chain according to SEQ ID NO:225 and a light chain according to SEQ ID NO:226 (TPP-14099),
mm. a heavy chain according to SEQ ID NO:239 and a light chain according to SEQ ID NO:240 (TPP-15285), or
nn. a heavy chain according to SEQ ID NO:253 and a light chain according to SEQ ID NO:254 (TPP-15286).

79. The isolated antibody or antigen-binding fragment thereof according to any of embodiments 68 to 78, wherein the antibody or antigen-binding fragment is afucosylated.

80. The isolated antibody or antigen-binding fragment thereof according to any of embodiments 68 to 79, wherein the antibody induces ADCC and/or ADCP.

81. A conjugate comprising an antibody or antigen-binding fragment according to any of embodiments 68 to 80, preferably wherein the conjugate comprises
   a. a radioactive element,
   b. a cytotoxic agent, such as an auristatin, a maytansinoid, a kinesin-spindle protein inhibitor, a nicotinamide phosphoribosyltransferase inhibitor or a pyrrolobenzodiazepine derivative,
   c. a further antibody or antigen-binding fragment, or
   d. a chimeric antigen receptor.

82. A pharmaceutical composition comprising an antibody or antigen-binding fragment according to any of embodiments 68 to 80 or a conjugate according to embodiment 81 and optionally comprising one or more further therapeutically active compounds, preferably selected from
   a. an antibody or a small molecule targeting a checkpoint protein, such as PD1, PD-L1 or CTLA-4,
   b. an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
   c. an antibody targeting a protein which is specifically expressed by tumor cells,
   d. an antibody or a small molecule targeting HER2 and/or EGFR,
   e. the standard of care for any of head and neck cancer, breast cancer, gastric cancer, lung cancer, squamous cell carcinoma, esophageal tumor, melanoma, bladder cancer, liver cancer, and/or prostate cancer,
   f. a chemotherapeutic agent, preferably a taxane, paclitaxel, doxorubicin, cis-platin, carboplatin, oxaliplatin, or gemcitabine, and/or
   g. a targeted kinase inhibitor, such as Sorafinib, Regorafenib, or MEKi-1.

83. An antibody or antigen-binding fragment according to any of embodiments 68 to 80 or a conjugate according to embodiment 81 or a pharmaceutical composition according to embodiment 82 for use as a medicament.

84. An antibody or antigen-binding fragment according to any of embodiments 68 to 80 or a conjugate according to embodiment 81 or a pharmaceutical composition according to embodiment 82 for use in the treatment of a tumor or a disease characterized by CCR8 positive cells, such as CCR8 positive tumor cells or CCR8 positive regulatory T cells.

85. An antibody or antigen-binding fragment according to any of embodiments 68 to 80 or a conjugate according to embodiment 81 or a pharmaceutical composition according to embodiment 82 for use in simultaneous, separate, or sequential combination
   (i) with one or more further therapeutically active compounds, preferably selected from
      a. an antibody or a small molecule targeting a checkpoint protein, such as PD1, PD-L1 or CTLA-4,
      b. an antibody targeting a further chemokine receptor, such as CCR1, CCR2, CCR3, CCR4, CCR5, CCR6, CCR7, CCR8, CCR9, CCR10, CXCR1, CXCR2, CXCR3, CXCR4, CXCR5, CXCR6, CX3CR1 or CXCR1,
      c. an antibody targeting a protein which is specifically expressed by the tumor cells,
      d. an antibody or a small molecule targeting HER2 and/or EGFR,
      e. the standard of care for any of head and neck cancer, breast cancer, gastric cancer, lung cancer, squamous cell carcinoma, esophageal tumor, melanoma, bladder cancer, liver cancer, and/or prostate cancer,
      f. a chemotherapeutic agent, preferably a taxane, paclitaxel, doxorubicin, cis-platin, carboplatin, oxaliplatin, or gemcitabine and/or
      g. a targeted kinase inhibitor, such as Sorafinib, Regorafenib, or MEKi-1, and/or
   (ii) with radiation therapy, and/or
   (iii) with depletion of intra-tumoral B cells,
   in the treatment of a tumor or a disease characterized by CCR8 positive cells, such as CCR8 positive regulatory T cells.
86. The antibody, fragment, conjugate or pharmaceutical composition for use according to any of embodiments 84 or 85, wherein the tumor is selected from the group of T-cell acute lymphoblastic leukemia, breast cancer, triple-negative breast cancer, triple positive breast cancer, non-small cell lung cancer (NSCLC), small cell lung cancer (SCLC), testicular cancer, gastric cancer, head and neck squamous cell carcinoma, thymoma, esophageal adenocarcinoma, colorectal cancer, pancreatic adenocarcinoma, ovarian cancer or cervical cancer, acute myeloid leukemia, kidney cancer, bladder cancer, skin cancer, melanoma, thyroid cancer, mesothelioma, sarcoma and prostate cancer, B cell lymphoma, T cell lymphoma or any other cancer involving CCR8 expressing cells, preferably wherein the tumor is selected from head and neck cancer, breast cancer, gastric cancer, lung cancer, squamous cell carcinoma, esophageal tumors, B cell lymphoma, melanoma and T cell lymphoma.
87. A polynucleotide encoding an antibody or antigen-binding fragment according to any of embodiments 68 to 80.
88. A vector comprising a polynucleotide according to embodiment 87.
89. An isolated cell arranged for production of an antibody or antigen-binding fragment according to any of embodiments 68 to 80.
90. A method of producing an antibody or antigen-binding fragment according to any of embodiments 68 to 80 or a conjugate according to embodiment 81, comprising culturing a cell according to embodiment 89 and optionally purification of the antibody or antigen-binding fragment.
91. The antibody or antigen-binding fragment according to any of embodiments 68 to 80 or a conjugate according to embodiment 81 for use as a diagnostic agent in vivo.
92. A kit comprising an antibody or antigen-binding fragment according to any of embodiments 68 to 80 or a conjugate according to embodiment 81 or a pharmaceutical composition according to embodiment 82 with instructions for use.
93. An anti-CCR8 antibody inducing ADCC and/or ADCP for use in the treatment of a tumor, wherein the use comprises administration of a further therapeutically active compound or therapy, wherein a dose of the further therapeutically active compound or therapy is administered after the first dose of the anti-CCR8 antibody, preferably
   a. after the anti-CCR8 antibody has induced an increase of the intra-tumoral CD8 cell to T reg cell ratio at least by a factor of 2, 3, 4 or 5 or
   b. after the anti-CCR8 antibody has depleted at least 40, 45, 50, 55, 60, 65 or 70% of the intra-tumoral Treg cells.
94. The anti-CCR8 antibody for use according to embodiment 93 wherein the further therapeutically active compound or therapy is selected from
   a. an antibody or a small molecule targeting a checkpoint protein, such as PD(L)1 or CTLA-4,
   b. a chemotherapeutic agent, preferably a taxane, paclitaxel, doxorubicin, cis-platin, carboplatin, oxaliplatin, or gemcitabine,
   c. an antibody targeting a further chemokine receptor, such as CCR1, CCR2, CCR3, CCR4, CCR5, CCR6, CCR7, CCR9, CCR10, CXCR1, CXCR2, CXCR3, CXCR4, CXCR5, CXCR6, CX3CR1 or CXCR1,
   d. an antibody targeting a protein which is specifically expressed by the tumor cells,
   e. an antibody or a small molecule targeting HER2 and/or EGFR,
   f. a targeted kinase inhibitor, such as Sorafinib, Regorafenib, or MEKi-1,
   g. radiation therapy, and/or
   h. depletion of intra-tumoral B cells, preferably CD19+ B cells.
95. An anti-CCR8 antibody inducing ADCC and/or ADCP for use in the treatment of a tumor, wherein the use comprises administration of a further therapeutically active compound or therapy which does not target a checkpoint protein and is selected from
   a. a chemotherapeutic agent, preferably a taxane, paclitaxel, doxorubicin, cis-platin, carboplatin, oxaliplatin, or gemcitabine,
   b. an antibody targeting a further chemokine receptor, such as CCR1, CCR2, CCR3, CCR4, CCR5, CCR6, CCR7, CCR9, CCR10, CXCR1, CXCR2, CXCR3, CXCR4, CXCR5, CXCR6, CX3CR1 or CXCR1,
   c. an antibody targeting a protein which is specifically expressed by the tumor cells,
   d. an antibody or a small molecule targeting HER2 and/or EGFR,
   e. a targeted kinase inhibitor, such as Sorafinib, Regorafenib, or MEKi-1,
   f. radiation therapy, and/or
   g. depletion of intra-tumoral B cells, preferably CD19+ B cells.

96. The anti-CCR8 antibody for use according to any of embodiments 93 to 95, wherein the use comprises furthermore administration of a checkpoint inhibitor such as an anti-PD-1 antibody, an anti-PD-L1 antibody or a CTLA4 antibody.

97. An anti-CCR8 antibody inducing ADCC and/or ADCP for use in the treatment of a tumor, wherein only a single dose of the anti-CCR8 antibody is administered to a subject, such that no further dose of the same or a different anti-CCR8 antibody is administered to the subject.

98. A biomarker for use in a method for diagnosing/stratifying a subject as having a tumor that is sensitive for treatment with an anti-CCR8 antibody, the use comprising
   a. determining the level of the biomarker in a tumor or tumor sample comprising regulatory T cells,
   b. comparing the level of the biomarker with a reference sample or value, and
   c. diagnosing/stratifying a subject as having a tumor that is sensitive for treatment with an anti-CCR8 antibody, if the level of the biomarker is higher than or equal to a reference sample or value,
   wherein the biomarker is
   d. an immune checkpoint protein, preferably PD-1, PD-L1 or CTLA4,
   e. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof,
   f. a Treg infiltration marker, preferably CCR8, FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7 or CXCL9,
   g. a T cell marker or cytotoxic T cell marker preferably selected from CD3, CD4, CD8, CD25, CXCR3, CCR5, 4-1BB, OX-40, or GITR,
   h. an interferon or interferon-inducible protein preferably selected from IFN gamma, IL10, IL12p70, IL1beta, IL2 and TNF alpha,
   i. a complement factor, and/or
   j. a serpin.

99. Use of a biomarker to predict or monitor the therapeutic success of a therapy comprising the administration of an anti-CCR8 antibody, the use comprising
   a. determining the level of the biomarker in a tumor sample, and
   b. comparing the level of the biomarker with a reference sample or value, wherein the biomarker is
   c. an immune checkpoint protein, preferably PD-1, PD-L1 or CTLA4,
   d. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof,
   e. a Treg infiltration marker, preferably selected from FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7, CXCL9,
   f. a T cell marker or cytotoxic T cell marker, preferably selected from CD3, CD4, CD8, CD25, CXCR3, CCR5, and TNF receptor super family members such as 4-1BB, OX-40, or GITR,
   g. an interferon-inducible protein, preferably selected from IFN gamma, IL10, IL12p70, IL1beta, IL2 and TNF alpha,
   h. a complement factor, and/or
   i. a serpin.

100. The biomarker for use according to embodiment 98, or the use of the biomarker according to embodiment 99, wherein the biomarker is an immune checkpoint protein, preferably PD-1, PD-L1 or CTLA4.

101. A molecule binding a biomarker for use in a method for diagnosing/stratifying a subject as having a tumor that is sensitive for treatment with an anti-CCR8 antibody, the use comprising determining the level of the biomarker in a tumor or tumor sample using the molecule binding the biomarker, wherein the biomarker is
   a. an immune checkpoint protein, preferably PD-1, PD-L1 or CTLA4,
   b. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof,
   c. a Treg infiltration marker, preferably CCR8, FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7 or CXCL9,
   d. a T cell marker or cytotoxic T cell marker preferably selected from CD3, CD4, CD8, CD25, CXCR3, CCR5, 4-1BB, OX-40, or GITR,
   e. an interferon or interferon-inducible protein preferably selected from IFN gamma, IL10, IL12p70, IL1beta, IL2 and TNF alpha,
   f. a complement factor, and/or
   g. a serpin,
   and wherein the molecule binding the biomarker is preferably an antibody or antigen-binding fragment, or a conjugate thereof.

102. Use of a molecule binding a biomarker to predict or monitor the therapeutic success of a therapy comprising the administration of an anti-CCR8 antibody, the use comprising determining the level of the biomarker in a tumor or tumor sample using the molecule binding the biomarker, wherein the biomarker is
   a. an immune checkpoint protein, preferably PD-1, PD-L1 or CTLA4,
   b. a granzyme or immune cell marker, preferably a marker for lymphocytes, effector cells, T cells, cytotoxic T cells, macrophage cells, M1 macrophage cells, M2 macrophage cells, B cells, NK cells, or a combination thereof,
   c. a Treg infiltration marker, preferably selected from FOXP3, ICOS, CCR4, TIGIT, P2RY10, CD80, TNFRSF9, CD3(G), SLAMF1, IL7R, IL2RB, CTLA4, CD5, ITK, IL2RA, LAX1, IKZF3, GBP5, CXCR6, SIRPG, CD2, CSF2RB, SLAMF7, CXCL9,
   d. a T cell marker or cytotoxic T cell marker, preferably selected from CD3, CD4, CD8, CD25, CXCR3, CCR5, and TNF receptor super family members such as 4-1BB, OX-40, or GITR,
   e. an interferon-inducible protein, preferably selected from IFN gamma, IL10, IL12p70, IL1beta, IL2 and TNF alpha, f. a complement factor, and/or
g. a serpin,
and wherein the molecule binding the biomarker is preferably an antibody or antigen-binding fragment, or a conjugate thereof
103. The molecule binding a biomarker for use according to embodiment 101 or the use of a molecule binding a biomarker according to embodiment 102, wherein the molecule binding the biomarker is an anti-PD-1, anti-PD-L1 or anti-CTLA4 antibody such as Nivolumab, Pembrolizumab, Atezolizumab, Avelumab, Durvalumab, Cemiplimab, Dostarlimab or Ipilimumab.
104. The molecule binding a biomarker for use according to embodiment 100 or the use of a molecule binding a biomarker according to embodiment 101, wherein the biomarker is an immune cell marker, and wherein the molecule binding a biomarker is preferably an antibody binding a marker for lymphocytes, effector cells, T cells, cytotoxic T cells, macrophage cells, M1 macrophage cells, M2 macrophage cells, B cells, NK cells, or a combination thereof.
105. The molecule binding a biomarker for use or the use of a molecule binding a biomarker according to embodiment 104, wherein the molecule binding the biomarker is a molecule binding a Treg infiltration marker, preferably an antibody binding CCR8, FOXP3, ICOS, CCR4, TIGIT, P2RY10, CD80, TNFRSF9, CD3 (G), SLAMF1, IL7R, IL2RB, CTLA4, CD5, ITK, IL2RA, LAX1, IKZF3, GBP5, CXCR6, SIRPG, CD2, CSF2RB, SLAMF7 or CXCL9.
106. The molecule binding a biomarker for use or the use of a molecule binding a biomarker according to embodiment 104, wherein the molecule binding the biomarker is an antibody binding a T cell marker preferably selected from CD3, CD4, CD8, CD25, CXCR3, CCR5, and TNF receptor super family members including 4-1BB, OX-40, or GITR.
107. The molecule binding a biomarker for use according to embodiment 101 or the use of a molecule binding a biomarker according to embodiment 102, wherein the molecule binding the biomarker is an antibody binding an interferon or interferon-inducible protein preferably selected from INF gamma, IL10, IL12p70, IL1beta, IL2 and TNF alpha.

SEQUENCE LISTING (973 sequences)

SEQ ID NO: 1 - protein, 23 aa, Artificial Sequence
  >sp|P32246|CCR1_HUMAN_TRD
METPNTTEDYDTTTEFDYGDATP

SEQ ID NO: 2 - protein, 23 aa, Artificial Sequence
  >sp|Q2Y2P0|CCR1_MACFA_TRD
METPDTTENYDMITEFDYGDATP

SEQ ID NO: 3 - protein, 23 aa, Artificial Sequence
  >sp|P51675|CCR1_MOUSE_TRD
MEISDFTEAYPTTTEFDYGDSTP

SEQ ID NO: 4 - protein, 34 aa, Artificial Sequence
  >sp|P32246|CCR1_HUMAN_N term
  misc_feature (24)..(24): Xaa can be any naturally occurring amino acid
METPNTTEDYDTTTEFDYGDATPXQKVNERAFGA

SEQ ID NO: 5 - protein, 34 aa, Artificial Sequence
  >sp|Q2Y2P0|CCR1_MACFA_N term
  misc_feature (24)..(24): Xaa can be any naturally occurring amino acid
METPDTTENYDMITEFDYGDATPXHKVNERAILA

SEQ ID NO: 6 - protein, 34 aa, Artificial Sequence
  >sp|P51675|CCR1_MOUSE_N term
  misc_feature (24)..(24): Xaa can be any naturally occurring amino acid
MEISDFTEAYPTTTEFDYGDSTPXQKTAVRAFGA

SEQ ID NO: 7 - protein, 31 aa, Artificial Sequence
  >sp|P41597|CCR2_HUMAN_TRD
MLSTSRSRFIRNTNESGEEVTTFFDYDYGAP

SEQ ID NO: 8 - protein, 31 aa, Artificial Sequence
  >sp|O18793|CCR2_MACMU_TRD
MLSTSRSRFIRNTNGSGEEVTTFFDYDYGAP

SEQ ID NO: 9 - protein, 44 aa, Artificial Sequence
  >sp|P51683|CCR2_MOUSE_TRD
MEDNNMLPQFIHGILSTSHSLFTRSIQELDEGATTPYDYDDGEP

SEQ ID NO: 10 - protein, 42 aa, Artificial Sequence
  >sp|P41597|CCR2_HUMAN_N term
  misc_feature (32)..(32): Xaa can be any naturally occurring amino acid
MLSTSRSRFIRNTNESGEEVTTFFDYDYGAPXHKFDVKQIGA

SEQ ID NO: 11 - protein, 42 aa, Artificial Sequence
  >sp|O18793|CCR2_MACMU_N term
  misc_feature (32)..(32): Xaa can be any naturally occurring amino acid
MLSTSRSRFIRNTNGSGEEVTTFFDYDYGAPXHKFDVKQIGA

SEQ ID NO: 12 - protein, 55 aa, Artificial Sequence
  >sp|P51683|CCR2_MOUSE_N term
  misc_feature (45)..(45): Xaa can be any naturally occurring amino acid
MEDNNMLPQFIHGILSTSHSLFTRSIQELDEGATTPYDYDDGEPXHKTSVKQIGA

SEQ ID NO: 13 - protein, 23 aa, Artificial Sequence
  >sp|P51677|CCR3_HUMAN_TRD
MTTSLDTVETFGTTSYYDDVGLL

SEQ ID NO: 14 - protein, 23 aa, Artificial Sequence
  >sp|Q9BDS8|CCR3_MACFA_TRD
MTTSLDTVETFGPTSYDDDMGLL

SEQ ID NO: 15 - protein, 27 aa, Artificial Sequence
  >sp|P51678|CCR3_MOUSE_TRD
MAFNTDEIKTVVESFETTPYEYEWAPP

SEQ ID NO: 16 - protein, 34 aa, Artificial Sequence
  >sp|P51677|CCR3_HUMAN_N term
  misc_feature (24)..(24): Xaa can be any naturally occurring amino acid
MTTSLDTVETFGTTSYYDDVGLLXEKADTRALMA

SEQ ID NO: 17 - protein, 34 aa, Artificial Sequence
  >sp|Q9BDS8|CCR3_MACFA_N term
  misc_feature (24)..(24): Xaa can be any naturally occurring amino acid
MTTSLDTVETFGPTSYDDDMGLLXEKADVGALIA

SEQ ID NO: 18 - protein, 38 aa, Artificial Sequence
  >sp|P51678|CCR3_MOUSE_N term
  misc_feature (28)..(28): Xaa can be any naturally occurring amino acid
MAFNTDEIKTVVESFETTPYEYEWAPPXEKVRIKELGS

SEQ ID NO: 19 - protein, 28 aa, Artificial Sequence
  >sp|P51679|CCR4_HUMAN_TRD
MNPTDIADTTLDESIYSNYYLYESIPKP

SEQ ID NO: 20 - protein, 28 aa, Artificial Sequence
  >tr|G7NYB7|CCR4_MACFA_TRD
MNPTDIADTTLDESIYSNYYLYESIPKP

SEQ ID NO: 21 - protein, 28 aa, Artificial Sequence
  >sp|P51680|CCR4_MOUSE_TRD
MNATEVTDTTQDETVYNSYYFYESMPKP

SEQ ID NO: 22 - protein, 39 aa, Artificial Sequence
  >sp|P51679|CCR4_HUMAN_N term
  misc_feature (29)..(29): Xaa can be any naturally occurring amino acid
MNPTDIADTTLDESIYSNYYLYESIPKPXTKEGIKAFGE

SEQ ID NO: 23 - protein, 39 aa, Artificial Sequence; identical to SEQ ID NO: 22
  >tr|G7NYB7|CCR4_MACFA_N term
  misc_feature (29)..(29): Xaa can be any naturally occurring amino acid

SEQ ID NO: 24 - protein, 39 aa, Artificial Sequence
  >sp|P51680|CCR4_MOUSE_N term
  misc_feature (29)..(29): Xaa can be any naturally occurring amino acid
MNATEVTDTTQDETVYNSYYFYESMPKPXTKEGIKAFGE

SEQ ID NO: 25 - protein, 19 aa, Artificial Sequence
  >sp|P51681|CCR5_HUMAN_TRD
MDYQVSSPIYDINYYTSEP

SEQ ID NO: 26 - protein, 19 aa, Artificial Sequence
  >sp|P61814|CCR5_MACFA_TRD
MDYQVSSPTYDIDYYTSEP

SEQ ID NO: 27 - protein, 21 aa, Artificial Sequence
  >sp|P51682|CCR5_MOUSE_TRD
MDFQGSVPTYSYDIDYGMSAP

SEQ ID NO: 28 - protein, 30 aa, Artificial Sequence
  >sp|P51681|CCR5_HUMAN_N term
  misc_feature (20)..(20): Xaa can be any naturally occurring amino acid
MDYQVSSPIYDINYYTSEPXQKINVKQIAA

SEQ ID NO: 29 - protein, 30 aa, Artificial Sequence
  >sp|P61814|CCR5_MACFA_N term
  misc_feature (20)..(20): Xaa can be any naturally occurring amino acid
MDYQVSSPTYDIDYYTSEPXQKINVKQIAA

SEQ ID NO: 30 - protein, 32 aa, Artificial Sequence
  >sp|P51682|CCR5_MOUSE_N term
  misc_feature (22)..(22): Xaa can be any naturally occurring amino acid
MDFQGSVPTYSYDIDYGMSAPXQKINVKQIAA

SEQ ID NO: 31 - protein, 35 aa, Artificial Sequence
  >sp|P51684|CCR6_HUMAN_TRD
MSGESMNFSDVFDSSEDYFVSVNTSYYSVDSEMLL

SEQ ID NO: 32 - protein, 40 aa, Artificial Sequence
  >tr|A0A2K5WY45|CCR6_MACFA_TRD
MFLPTMSGESMNFSDVFDSSEDYFASVNTSYYTVDSEMLL

SEQ ID NO: 33 - protein, 27 aa, Artificial Sequence
  >sp|O54689|CCR6_MOUSE_TRD
MNSTESYFGTDDYDNTEYYSIPPDHGP

SEQ ID NO: 34 - protein, 47 aa, Artificial Sequence
  >sp|P51684|CCR6_HUMAN_N term
  misc_feature (36)..(36): Xaa can be any naturally occurring amino acid
MSGESMNFSDVFDSSEDYFVSVNTSYYSVDSEMLLXSLQEVRQFSRL

SEQ ID NO: 35 - protein, 52 aa, Artificial Sequence
  >tr|A0A2K5WY45|CCR6_MACFA_N term
  misc_feature (41)..(41): Xaa can be any naturally occurring amino acid
MFLPTMSGESMNFSDVFDSSEDYFASVNTSYYTVDSEMLLXTLHEVRQFSRL

SEQ ID NO: 36 - protein, 39 aa, Artificial Sequence
  >sp|O54689|CCR6_MOUSE_N term
  misc_feature (28)..(28): Xaa can be any naturally occurring amino acid
MNSTESYFGTDDYDNTEYYSIPPDHGPXSLEEVRNFTKV

SEQ ID NO: 37 - protein, 23 aa, Artificial Sequence
  >sp|P32248|CCR7_HUMAN_TRD
QDEVTDDYIGDNTTVDYTLFESL

SEQ ID NO: 38 - protein, 23 aa, Artificial Sequence
  >tr|C0ISS3|CCR7_MACFA_TRD
QDEVTDDYIGDNTTVDYTLFESL

SEQ ID NO: 39 - protein, 23 aa, Artificial Sequence
  >sp|P47774|CCR7_MOUSE_TRD
QDEVTDDYIGENTTVDYTLYESV

SEQ ID NO: 40 - protein, 35 aa, Artificial Sequence
  >sp|P32248|CCR7_HUMAN_N term (w/o Signal Peptide))
  misc_feature (24)..(24): Xaa can be any naturally occurring amino acid
QDEVTDDYIGDNTTVDYTLFESLXSKKDVRNFKAW

SEQ ID NO: 41 - protein, 35 aa, Artificial Sequence; identical to SEQ ID NO: 40
  >tr|C0ISS3|CCR7_MACFA_N term (w/o  Signal Peptide))
  misc_feature (24)..(24): Xaa can be any naturally occurring amino acid

SEQ ID NO: 42 - protein, 35 aa, Artificial Sequence
  >sp|P47774|CCR7_MOUSE_N term (w/o  Signal Peptide))
  misc_feature (24)..(24): Xaa can be any naturally occurring amino acid
QDEVTDDYIGENTTVDYTLYESVXFKKDVRNFKAW

SEQ ID NO: 43 - protein, 24 aa, Artificial Sequence
  >sp|P51685|CCR8_HUMAN_TRD
MDYTLDLSVTTVTDYYYPDIFSSP

SEQ ID NO: 44 - protein, 24 aa, Artificial Sequence
  >sp|G7NYJ2|CCR8_MACFA_TRD
MDYTLDPSMTTMTDYYYPDSLSSP

SEQ ID NO: 45 - protein, 22 aa, Artificial Sequence
  >sp|P56484|CCR8_MOUSE_TRD
MDYTMEPNVTMTDYYPDFFTAP

SEQ ID NO: 46 - protein, 35 aa, Artificial Sequence
  >sp|P51685|CCR8_HUMAN_N term
  misc_feature (25)..(25): Xaa can be any naturally occurring amino acid
MDYTLDLSVTTVTDYYYPDIFSSPXDAELIQTNGK

SEQ ID NO: 47 - protein, 35 aa, Artificial Sequence
  >sp|G7NYJ2|CCR8_MACFA_N term
  misc_feature (25)..(25): Xaa can be any naturally occurring amino acid
MDYTLDPSMTTMTDYYYPDSLSSPXDGELIQRNDK

SEQ ID NO: 48 - protein, 33 aa, Artificial Sequence
  >sp|P56484|CCR8_MOUSE_N term
  misc_feature (23)..(23): Xaa can be any naturally occurring amino acid
MDYTMEPNVTMTDYYPDFFTAPXDAEFLLRGSM

SEQ ID NO: 49 - protein, 10 aa, Artificial Sequence
  >sp|P51685|CCR8_HUMAN_LID
DAELIQTNGK

SEQ ID NO: 50 - protein, 10 aa, Artificial Sequence
  >sp|G7NYJ2|CCR8_MACFA_LID
DGELIQRNDK

SEQ ID NO: 51 - protein, 10 aa, Artificial Sequence
  >sp|P56484|CCR8_MOUSE_LID
DAEFLLRGSM

SEQ ID NO: 52 - protein, 14 aa, Artificial Sequence
  >sp|P51685|CCR8_HUMAN_ECL1
YLLDQWVFGTVMCK

SEQ ID NO: 53 - protein, 14 aa, Artificial Sequence
  >sp|G7NYJ2|CCR8_MACFA_ECL1
YQLDQWVFGTVMCK

SEQ ID NO: 54 - protein, 14 aa, Artificial Sequence
  >sp|P56484|CCR8_MOUSE_ECL1
NLLDQWVFGTAMCK

SEQ ID NO: 55 - protein, 31 aa, Artificial Sequence
  >sp|P51685|CCR8_HUMAN_ECL2
YQVASEDGVLQCYSFYNQQTLKWKIFTNFKM

SEQ ID NO: 56 - protein, 31 aa, Artificial Sequence
  >sp|G7NYJ2|CCR8_MACFA_ECL2
YQVASEDGVLQCYSFYNQQTLKWKIFTNFEM

SEQ ID NO: 57 - protein, 31 aa, Artificial Sequence
  >sp|P56484|CCR8_MOUSE_ECL2
YQVASEDGMLQCFQFYEEQSLRWKLFTHFEI

SEQ ID NO: 58 - protein, 17 aa, Artificial Sequence
  >sp|P51685|CCR8_HUMAN_ECL3
HSMHILDGCSISQQLTY

SEQ ID NO: 59 - protein, 17 aa, Artificial Sequence
  >sp|G7NYJ2|CCR8_MACFA_ECL3
HSMHILDGCSISQQLNY

SEQ ID NO: 60 - protein, 17 aa, Artificial Sequence
  >sp|P56484|CCR8_MOUSE_ECL3
HDLHILDGCATRQRLAL

SEQ ID NO: 61 - protein, 37 aa, Artificial Sequence
  >sp|P51686|CCR9_HUMAN_TRD
MTPTDFTSPIPNMADDYGSESTSSMEDYVNFNFTDFY

SEQ ID NO: 62 - protein, 37 aa, Artificial Sequence
  >tr|Q0H741|CCR9_MACFA_TRD
MTPTEFTSPVPNMADDYGSESTSSMEDYVNFNFTDFY

SEQ ID NO: 63 - protein, 37 aa, Artificial Sequence; identical to SEQ ID NO: 62
  >sp|Q9WUT7|CCR9_MOUSE_TRD

SEQ ID NO: 64 - protein, 48 aa, Artificial Sequence
  >sp|P51686|CCR9_HUMAN_N term
  misc_feature (38)..(38): Xaa can be any naturally occurring amino acid
MTPTDFTSPIPNMADDYGSESTSSMEDYVNFNFTDFYXEKNNVRQFAS

SEQ ID NO: 65 - protein, 48 aa, Artificial Sequence
  >tr|Q0H741|CCR9_MACFA_N term
  misc_feature (38)..(38): Xaa can be any naturally occurring amino acid
MTPTEFTSPVPNMADDYGSESTSSMEDYVNFNFTDFYXEKNNVRQFAS

SEQ ID NO: 66 - protein, 48 aa, Artificial Sequence; identical to SEQ ID NO: 65
  >sp|Q9WUT7|CCR9_MOUSE_N term
  misc_feature (38)..(38): Xaa can be any naturally occurring amino acid

SEQ ID NO: 67 - protein, 30 aa, Artificial Sequence
  >sp|P46092|CCR10_HUMAN_TRD
MGTEATEQVSWGHYSGDEEDAYSAEPLPEL

SEQ ID NO: 68 - protein, 30 aa, Artificial Sequence
  >tr|A0A2K5UAP1|CCR10_MACFA_TRD
MGTEATEQVSWGHYSGDEEEAYSAEPLPEL

SEQ ID NO: 69 - protein, 30 aa, Artificial Sequence
  >sp|Q9JL21|CCR10_MOUSE_TRD
MGTKPTEQVSWGLYSGYDEEAYSVGPLPEL

SEQ ID NO: 70 - protein, 52 aa, Artificial Sequence
  >sp|P46092|CCR10_HUMAN_N term
  misc_feature (31)..(31): Xaa can be any naturally occurring amino acid
MGTEATEQVSWGHYSGDEEDAYSAEPLPELXYKADVQAFSRAFQPSVSLTVA

SEQ ID NO: 71 - protein, 52 aa, Artificial Sequence
  >tr|A0A2K5UAP1|CCR10_MACFA_N term
  misc_feature (31)..(31): Xaa can be any naturally occurring amino acid
MGTEATEQVSWGHYSGDEEEAYSAEPLPELXYKADVQAFSRAFQPSVSLTVA

SEQ ID NO: 72 - protein, 48 aa, Artificial Sequence
  >sp|Q9JL21|CCR10_MOUSE_N term
  misc_feature (31)..(31): Xaa can be any naturally occurring amino acid
MGTKPTEQVSWGLYSGYDEEAYSVGPLPELXYKADVQAFSRAFQPSVS

SEQ ID NO: 73 - protein, 29 aa, Artificial Sequence
  >sp|P25024|CXCR1_HUMAN_TRD
MSNITDPQMWDFDDLNFTGMPPADEDYSP

SEQ ID NO: 74 - protein, 30 aa, Artificial Sequence
  >tr|A0A2K5X9E4|CXCR1_MACFA_TRD
MSNATDPQMGDDDYDLNFTGMPPTDEDYSP

SEQ ID NO: 75 - protein, 35 aa, Artificial Sequence
  >sp|Q810W6|CXCR1_MOUSE_TRD
MAEAEYFIWTNPEGDFEKEFGNITGMLPTGDYFIP

SEQ ID NO: 76 - protein, 39 aa, Artificial Sequence
  >sp|P25024|CXCR1_HUMAN_N term
  misc_feature (30)..(30): Xaa can be any naturally occurring amino acid
MSNITDPQMWDFDDLNFTGMPPADEDYSPXMLETETLNK

SEQ ID NO: 77 - protein, 40 aa, Artificial Sequence
  >tr|A0A2K5X9E4|CXCR1_MACFA_N term
  misc_feature (31)..(31): Xaa can be any naturally occurring amino acid
MSNATDPQMGDDDYDLNFTGMPPTDEDYSPXRLETQSLNK

SEQ ID NO: 78 - protein, 44 aa, Artificial Sequence
  >sp|Q810W6|CXCR1_MOUSE_N term
  misc_feature (36)..(36): Xaa can be any naturally occurring amino acid
MAEAEYFIWTNPEGDFEKEFGNITGMLPTGDYFIPXKRVPITNR

SEQ ID NO: 79 - protein, 38 aa, Artificial Sequence
  >sp|P25025|CXCR2_HUMAN_TRD
MEDFNMESDSFEDFWKGEDLSNYSYSSTLPPFLLDAAP

SEQ ID NO: 80 - protein, 35 aa, Artificial Sequence
  >sp|Q28519|CXCR2_MACMU_TRD
FNMESDSFEDLWKGEDFSNYSYSSDLPPSLPDVAP

SEQ ID NO: 81 - protein, 37 aa, Artificial Sequence
  >sp|P35343|CXCR2_MOUSE_TRD
MGEFKVDKFNIEDFFSGDLDIFNYSSGMPSILPDAVP

SEQ ID NO: 82 - protein, 48 aa, Artificial Sequence
  >sp|P25025|CXCR2_HUMAN_N term
  misc_feature (39)..(39): Xaa can be any naturally occurring amino acid
MEDFNMESDSFEDFWKGEDLSNYSYSSTLPPFLLDAAPXEPESLEINK

SEQ ID NO: 83 - protein, 45 aa, Artificial Sequence
  >sp|Q28519|CXCR2_MACMU_N term
  misc_feature (36)..(36): Xaa can be any naturally occurring amino acid
FNMESDSFEDLWKGEDFSNYSYSSDLPPSLPDVAPXRPESLEINK

SEQ ID NO: 84 - protein, 47 aa, Artificial Sequence
  >sp|P35343|CXCR2_MOUSE_N term
  misc_feature (38)..(38): Xaa can be any naturally occurring amino acid
MGEFKVDKFNIEDFFSGDLDIFNYSSGMPSILPDAVPXHSENLEINS

SEQ ID NO: 85 - protein, 36 aa, Artificial Sequence
  >sp|P49682|CXCR3_HUMAN_TRD
MVLEVSDHQVLNDAEVAALLENFSSSYDYGENESDS

SEQ ID NO: 86 - protein, 36 aa, Artificial Sequence; identical to SEQ ID NO: 85
  >tr|A0A2K5UV19|CXCR3_MACFA_TRD

SEQ ID NO: 87 - protein, 41 aa, Artificial Sequence
  >sp|O88410|CXCR3_MOUSE_TRD
MYLEVSERQVLDASDFAFLLENSTSPYDYGENESDFSDSPP

SEQ ID NO: 88 - protein, 42 aa, Artificial Sequence
  >sp|P49682|CXCR3_HUMAN_N term
  misc_feature (37)..(38): Xaa can be any naturally occurring amino acid
MVLEVSDHQVLNDAEVAALLENFSSSYDYGENESDSXXTSPP

SEQ ID NO: 89 - protein, 42 aa, Artificial Sequence; identical to SEQ ID NO: 88
  >tr|A0A2K5UV19|CXCR3_MACFA_N term
  misc_feature (37)..(38): Xaa can be any naturally occurring amino acid

SEQ ID NO: 90 - protein, 52 aa, Artificial Sequence
  >sp|O88410|CXCR3_MOUSE_N term
  misc_feature (42)..(42): Xaa can be any naturally occurring amino acid
MYLEVSERQVLDASDFAFLLENSTSPYDYGENESDFSDSPPXPQDFSLNFDR

SEQ ID NO: 91 - protein, 27 aa, Artificial Sequence
  >sp|P61073|CXCR4_HUMAN_TRD
MEGISIYTSDNYTEEMGSGDYDSMKEP

SEQ ID NO: 92 - protein, 27 aa, Artificial Sequence
  >sp|Q28474|CXCR4_MACFA_TRD
MEGISIYTSDNYTEEMGSGDYDSIKEP

SEQ ID NO: 93 - protein, 29 aa, Artificial Sequence
  >sp|P70658|CXCR4_MOUSE_TRD
MEPISVSIYTSDNYSEEVGSGDYDSNKEP

SEQ ID NO: 94 - protein, 38 aa, Artificial Sequence
  >sp|P61073|CXCR4_HUMAN_N term
  misc_feature (28)..(28): Xaa can be any naturally occurring amino acid
MEGISIYTSDNYTEEMGSGDYDSMKEPXFREENANFNK

SEQ ID NO: 95 - protein, 38 aa, Artificial Sequence
  >sp|Q28474|CXCR4_MACFA_N term
  misc_feature (28)..(28): Xaa can be any naturally occurring amino acid
MEGISIYTSDNYTEEMGSGDYDSIKEPXFREENAHFNR

SEQ ID NO: 96 - protein, 40 aa, Artificial Sequence
  >sp|P70658|CXCR4_MOUSE_N term
  misc_feature (30)..(30): Xaa can be any naturally occurring amino acid
MEPISVSIYTSDNYSEEVGSGDYDSNKEPXFRDENVHFNR

SEQ ID NO: 97 - protein, 37 aa, Artificial Sequence
  >sp|P32302|CXCR5_HUMAN_TRD
MNYPLTLEMDLENLEDLFWELDRLDNYNDTSLVENHL

SEQ ID NO: 98 - protein, 37 aa, Artificial Sequence
  >tr|G8F5K4|CXCR5_MACFA_TRD
MNYPLMLEMDLENLEDLFLEFDKFDNYNDTSLVENHL

SEQ ID NO: 99 - protein, 39 aa, Artificial Sequence
  >sp|Q04683|CXCR5_MOUSE_TRD
MNYPLTLDMGSITYNMDDLYKELAFYSNSTEIPLQDSNF

SEQ ID NO: 100 - protein, 55 aa, Artificial Sequence
  >sp|P32302|CXCR5_HUMAN_N term
  misc_feature (38)..(38): Xaa can be any naturally occurring amino acid
MNYPLTLEMDLENLEDLFWELDRLDNYNDTSLVENHLXPATEGPLMASFKAVFVP

SEQ ID NO: 101 - protein, 55 aa, Artificial Sequence
  >tr|G8F5K4|CXCR5_MACFA_N term
  misc_feature (38)..(38): Xaa can be any naturally occurring amino acid
MNYPLMLEMDLENLEDLFLEFDKFDNYNDTSLVENHLXPATEGPLMASFKAVFVP

SEQ ID NO: 102 - protein, 57 aa, Artificial Sequence
  >sp|Q04683|CXCR5_MOUSE_N term
  misc_feature (40)..(40): Xaa can be any naturally occurring amino acid
MNYPLTLDMGSITYNMDDLYKELAFYSNSTEIPLQDSNFXSTVEGPLLTSFKAVFMP

SEQ ID NO: 103 - protein, 32 aa, Artificial Sequence
  >sp|O00574|CXCR6_HUMAN_TRD
MAEHDYHEDYGFSSFNDSSQEEHQDFLQFSKV

SEQ ID NO: 104 - protein, 33 aa, Artificial Sequence
  >sp|Q9BDS6|CXCR6_MACFA_TRD
MAEYDHYEDDGFLNSFNDSSQEEHQDFLQFRKV

SEQ ID NO: 105 - protein, 41 aa, Artificial Sequence
  >sp|Q9EQ16|CXCR6_MOUSE_TRD
MDDGHQESALYDGHYEGDFWLFNNSSDNSQENKRFLKFKEV

SEQ ID NO: 106 - protein, 43 aa, Artificial Sequence
  >sp|O00574|CXCR6_HUMAN_N term
  misc_feature (36)..(36): Xaa can be any naturally occurring amino acid
MAEHDYHEDYGFSSFNDSSQEEHQDFLQFSKVFLPXMYLVVFV

SEQ ID NO: 107 - protein, 44 aa, Artificial Sequence
  >sp|Q9BDS6|CXCR6_MACFA_N term
  misc_feature (37)..(37): Xaa can be any naturally occurring amino acid
MAEYDHYEDDGFLNSFNDSSQEEHQDFLQFRKVFLPXMYLVVFV

SEQ ID NO: 108 - protein, 45 aa, Artificial Sequence
  >sp|Q9EQ16|CXCR6_MOUSE_N term
  misc_feature (45)..(45): Xaa can be any naturally occurring amino acid
MDDGHQESALYDGHYEGDFWLFNNSSDNSQENKRFLKFKEVFLPX

SEQ ID NO: 109 - protein, 355 aa, Artificial Sequence
  >sp|P32246|CCR1_HUMAN
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 110 - protein, 355 aa, Artificial Sequence
  >sp|Q2Y2P0|CCR1_MACFA
METPDTTENYDMITEFDYGDATPCHKVNERAILAQLLPPLYSLVFVIGVVGNLLVVLVLVQYKRLKNMTNIYLLNLAISDLLFLFTLPFLIYYKSTDDWIFGDAMCKILSGFYYTGLYSEIFFIILLTIDRYLAIVHAVFALRARTVTFGVITSIIIWALAILASSPLMYFSKTQWNIVRHSCNLHFPYESFQQWKLFQALKLNLFGLVLPLLVMIVCYTGIIKILLRRPNEKKSKAVRLIFVIMIIFFLFWTPYNLTELISVFQEFLFTHLCEQNRQLDLAMEVTEVIANMHCCVNPVIYAFAGERFRKYLRQLFHRRVAVHLVKWLPFLSGDRLERVSSTSPSTGEHELSAGL

SEQ ID NO: 111 - protein, 355 aa, Artificial Sequence
  >sp|P51675|CCR1_MOUSE
MEISDFTEAYPTTTEFDYGDSTPCQKTAVRAFGAGLLPPLYSLVFIIGVVGNVLVILVLMQHRRLQSMTSIYLFNLAVSDLVFLFTLPFWIDYKLKDDWIFGDAMCKLLSGFYYLGLYSEIFFIILLTIDRYLAIVHAVFALRARTVTFGIITSIITWALAILASMPALYFFKAQWEFTHRTCSPHFPYKSLKQWKRFQALKLNLLGLILPLLVMIICYAGIIRILLRRPSEKKVKAVRLIFAITLLFFLLWTPYNLSVFVSAFQDVLFTNQCEQSKQLDLAMQVTEVIAYTHCCVNPIIYVFVGERFWKYLRQLFQRHVAIPLAKWLPFLSVDQLERTSSISPSTGEHELSAGF

SEQ ID NO: 112 - protein, 374 aa, Artificial Sequence
  >sp|P41597|CCR2_HUMAN
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 113 - protein, 360 aa, Artificial Sequence
  >sp|O18793|CCR2_MACMU
MLSTSRSRFIRNTNGSGEEVTTFFDYDYGAPCHKFDVKQIGAQLLPPLYSLVFIFGFVGNMLVVLILINCKKLKSLTDIYLLNLAISDLLFLITLPLWAHSAANEWVFGNAMCKLFTGLYHIGYLGGIFFIILLTIDRYLAIVHAVFALKARTVTFGVVTSVITWLVAVFASVPGIIFTKCQEEDSVYICGPYFPRGWNNFHTIMRNILGLVLPLLIMVICYSGILKTLLRCRNEKKRHRAVRLIFTIMIVYFLFWTPYNIVILLNTFQEFFGLSNCESTRQLDQATQVTETLGMTHCCINPIIYAFVGEKFRRYLSMFFRKYITKRFCKQCPVFYRETVDGVTSTNTPSTAEQEVSVGL

SEQ ID NO: 114 - protein, 373 aa, Artificial Sequence
  >sp|P51683|CCR2_MOUSE
MEDNNMLPQFIHGILSTSHSLFTRSIQELDEGATTPYDYDDGEPCHKTSVKQIGAWILPPLYSLVFIFGFVGNMLVIIILIGCKKLKSMTDIYLLNLAISDLLFLLTLPFWAHYAANEWVFGNIMCKVFTGLYHIGYFGGIFFIILLTIDRYLAIVHAVFALKARTVTFGVITSVVTWVVAVFASLPGIIFTKSKQDDHHYTCGPYFTQLWKNFQTIMRNILSLILPLLVMVICYSGILHTLFRCRNEKKRHRAVRLIFAIMIVYFLFWTPYNIVLFLTTFQESLGMSNCVIDKHLDQAMQVTETLGMTHCCINPVIYAFVGEKFRRYLSIFFRKHIAKRLCKQCPVFYRETADRVSSTFTPSTGEQEVSVGL

SEQ ID NO: 115 - protein, 355 aa, Artificial Sequence
  >sp|P51677|CCR3_HUMAN
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 116 - protein, 355 aa, Artificial Sequence
  >sp|Q9BDS8|CCR3_MACFA
MTTSLDTVETFGPTSYDDDMGLLCEKADVGALIAQFVPPLYSLVFMVGLLGNVVVVMILIKYRRLRIMTNIYLLNLAISDLLFLFTLPFWIHYVRERNWVFSHGMCKVLSGFYHTGLYSEIFFIILLTIDRYLAIVHAVFALRARTVTFGVVTSIVTWGLAVLAALPEFIFYGTEELFPETLCSAIYPQDTVYSWRHFHTLRMTILCLALPLLVMAICYTGIIKTLLRCPSKKKYKAIRLIFVIMAVFFIFWTPYNVAILISTYQSILFGPDCERSKHLDLFVLVTEVIAYSHCWVNPVIYAFVGERFRKYLRHFFHRHVLMHPGKYIPFLPSEKLERTSSVSPSTAEPELSIVF

SEQ ID NO: 117 - protein, 359 aa, Artificial Sequence
  >sp|P51678|CCR3_MOUSE
MAFNTDEIKTVVESFETTPYEYEWAPPCEKVRIKELGSWLLPPLYSLVFIIGLLGNMMVVLILIKYRKLQIMTNIYLFNLAISDLLFLFTVPFWIHYVLWNEWGFGHYMCKMLSGFYYLALYSEIFFIILLTIDRYLAIVHAVFALRARTVTFATITSIITWGLAGLAALPEFIFHESQDSFGEFSCSPRYPEGEEDSWKRFHALRMNIFGLALPLLIMVICYSGIIKTLLRCPNKKKHKAIRLIFVVMIVFFIFWTPYNLVLLFSAFHSTFLETSCQQSKHLDLAMQVTEVIAYTHCCINPVIYAFVGERFRKHLRLFFHRNVAVYLGKYIPFLPGEKMERTSSVSPSTGEQEISVVF

SEQ ID NO: 118 - protein, 360 aa, Artificial Sequence
  >sp|P51679|CCR4_HUMAN
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 119 - protein, 360 aa, Artificial Sequence
  >tr|G7NYB7|CCR4_MACFA
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWIYLVGFYSGIFFVMLMSIDRYLAIVHAVFSLRARTLTYGVITSLATWSVAVFASLPGFLFSTCYTERNHTYCKTKYSLNSTTWKVISSLEINILGLVIPFGIMLFCYSMIIRTLQHCKNEKKNKAVKMIFAVVVLFLGFWTPYNIVLFLETLVDLEVLQDCTFERYLDYAIQATETLAFVHCCLNPIIYFFLGEKFRKYILQLFKTCRGLFVLCQYCGFLQIYSADTPSSSYTQSTMDHDLHDAL

SEQ ID NO: 120 - protein, 360 aa, Artificial Sequence
  >sp|P51680|CCR4_MOUSE
MNATEVTDTTQDETVYNSYYFYESMPKPCTKEGIKAFGEVFLPPLYSLVFLLGLFGNSVVVLVLFKYKRLKSMTDVYLLNLAISDLLFVLSLPFWGYYAADQWVFGLGLCKIVSWMYLVGFYSGIFFIMLMSIDRYLAIVHAVFSLKARTLTYGVITSLITWSVAVFASLPGLLFSTCYTEHNHTYCKTQYSVNSTTWKVLSSLEINVLGLLIPLGIMLFCYSMIIRTLQHCKNEKKNRAVRMIFAVVVLFLGFWTPYNVVLFLETLVELEVLQDCTLERYLDYAIQATETLAFIHCCLNPVIYFFLGEKFRKYITQLFRTCRGPLVLCKHCDFLQVYSADMSSSSYTQSTVDHDFRDAL

SEQ ID NO: 121 - protein, 352 aa, Artificial Sequence [sequence omitted]

SEQ ID NO: 122 - protein, 352 aa, Artificial Sequence
  >sp|P61814|CCR5_MACFA
MDYQVSSPTYDIDYYTSEPCQKINVKQIAARLLPPLYSLVFIFGFVGNILVVLILINCKRLKSMTDIYLLNLAISDLLFLLTVPFWAHYAAAQWDFGNTMCQLLTGLYFIGFFSGIFFIILLTIDRYLAIVHAVFALKARTVTFGVVTSVITWVVAVFASLPGIIFTRSQREGLHYTCSSHFPYSQYQFWKNFQTLKMVILGLVLPLLVMVICYSGILKTLLRCRNEKKRHRAVRLIFTIMIVYFLFWAPYNIVLLLNTFQEFFGLNNCSSSNRLDQAMQVTETLGMTHCCINPIIYAFVGEKFRNYLLVFFQKHIAKRFCKCCSIFQQEAPERASSVYTRSTGEQEISVGL

SEQ ID NO: 123 - protein, 354 aa, Artificial Sequence
  >sp|P51682|CCR5_MOUSE
MDFQGSVPTYSYDIDYGMSAPCQKINVKQIAAQLLPPLYSLVFIFGFVGNMMVFLILISCKKLKSVTDIYLLNLAISDLLFLLTLPFWAHYAANEWVFGNIMCKVFTGLYHIGYFGGIFFIILLTIDRYLAIVHAVFALKVRTVNFGVITSVVTWAVAVFASLPEIIFTRSQKEGFHYTCSPHFPHTQYHFWKSFQTLKMVILSLILPLLVMVICYSGILHTLFRCRNEKKRHRAVRLIFAIMIVYFLFWTPYNIVLLLTTFQEFFGLNNCSSSNRLDQAMQATETLGMTHCCLNPVIYAFVGEKFRSYLSVFFRKHMVKRFCKRCSIFQQDNPDRASSVYTRSTGEHEVSTGL

SEQ ID NO: 124 - protein, 374 aa, Artificial Sequence
  >sp|P51684|CCR6_HUMAN
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 125 - protein, 379 aa, Artificial Sequence
  >tr|A0A2K5WY45|CCR6_MACFA
MFLPTMSGESMNFSDVFDSSEDYFASVNTSYYTVDSEMLLCTLHEVRQFSRLFVPIAYSLICVFGLLGNILVVITFAFYKKARSMTDVYLLNMAIADILFVLTLPFWAVSHATGAWVFSNAMCKLMKGIYAINFNCGMLLLTCISMDRYIAIVQATKSFRLRYRTLLRSKVICLIVWGVSVIISSSTFIFNQKYNIQGSDVCEPKYQTVSEPIKWKLLMLGLELLFGFFIPLMFMIFCYMFIVKTLVQAQNSKRHKAIRVIIAVVLVFLACQIPHNMVLLVTAANLGNMNRSCHSEKLLGYTKTVTEVLAFLHCCLNPVLYAFIGQKFRNYFLKIMKDLWCVRRKYKSSGFSCAGRYSENISRQTSETADNDNASSFTM

SEQ ID NO: 126 - protein, 367 aa, Artificial Sequence
  >sp|O54689|CCR6_MOUSE
MNSTESYFGTDDYDNTEYYSIPPDHGPCSLEEVRNFTKVFVPIAYSLICVFGLLGNIMVVMTFAFYKKARSMTDVYLLNMAITDILFVLTLPFWAVTHATNTWVFSDALCKLMKGTYAVNFNCGMLLLACISMDRYIAIVQATKSFRVRSRTLTHSKVICVAVWFISIIISSPTFIFNKKYELQDRDVCEPRYRSVSEPITWKLLGMGLELFFGFFTPLLFMVFCYLFIIKTLVQAQNSKRHRAIRVVIAVVLVFLACQIPHNMVLLVTAVNTGKVGRSCSTEKVLAYTRNVAEVLAFLHCCLNPVLYAFIGQKFRNYFMKIMKDVWCMRRKNKMPGFLCARVYSESYISRQTSETVENDNASSFTM

SEQ ID NO: 127 - protein, 378 aa, Artificial Sequence
  >sp|P32248|CCR7_HUMAN
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 128 - protein, 378 aa, Artificial Sequence
  >tr|C0ISS3|CCR7_MACFA
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSGLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 129 - protein, 378 aa, Artificial Sequence
  >sp|P47774|CCR7_MOUSE
MDPGKPRKNVLVVALLVIFQVCFCQDEVTDDYIGENTTVDYTLYESVCFKKDVRNFKAWFLPLMYSVICFVGLLGNGLVILTYIYFKRLKTMTDTYLLNLAVADILFLLILPFWAYSEAKSWIFGVYLCKGIFGIYKLSFFSGMLLLLCISIDRYVAIVQAVSAHRHRARVLLISKLSCVGIWMLALFLSIPELLYSGLQKNSGEDTLRCSLVSAQVEALITIQVAQMVFGFLVPMLAMSFCYLIIIRTLLQARNFERNKAIKVIIAVVVVFIVFQLPYNGVVLAQTVANFNITNSSCETSKQLNIAYDVTYSLASVRCCVNPFLYAFIGVKFRSDLFKLFKDLGCLSQERLRHWSSCRHVRNASVSMEAETTTTFSP

SEQ ID NO: 130 - protein, 355 aa, Artificial Sequence
  >sp|P51685|CCR8_HUMAN
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 131 - protein, 355 aa, Artificial Sequence
  >sp|G7NYJ2|CCR8_MACFA
MDYTLDPSMTTMTDYYYPDSLSSPCDGELIQRNDKLLLAVFYCLLFVFSLLGNSLVILVLVVCKKLRNITDIYLLNLALSDLLFVFSFPFQTYYQLDQWVFGTVMCKVVSGFYYIGFYSSMFFITLMSVDRYLAVVHAVYAIKVRTIRMGTTLSLVVWLTAIMATIPLLVFYQVASEDGVLQCYSFYNQQTLKWKIFTNFEMNILGLLIPFTIFMFCYIKILHQLKRCQNHNKTKAIRLVLIVVIASLLFWVPFNVVLFLTSLHSMHILDGCSISQQLNYATHVTEIISFTHCCVNPVIYAFVGEKFKKHLSEIFQKSCSHIFIYLGRQMPRESCEKSSSCQQHSFRSSSIDYIL

SEQ ID NO: 132 - protein, 353 aa, Artificial Sequence
  >sp|P56484|CCR8_MOUSE
MDYTMEPNVTMTDYYPDFFTAPCDAEFLLRGSMLYLAILYCVLFVLGLLGNSLVILVLVGCKKLRSITDIYLLNLAASDLLFVLSIPFQTHNLLDQWVFGTAMCKVVSGLYYIGFFSSMFFITLMSVDRYLAIVHAVYAIKVRTASVGTALSLTVWLAAVTATIPLMVFYQVASEDGMLQCFQFYEEQSLRWKLFTHFEINALGLLLPFAILLFCYVRILQQLRGCLNHNRTRAIKLVLTVVIVSLLFWVPFNVALFLTSLHDLHILDGCATRQRLALAIHVTEVISFTHCCVNPVIYAFIGEKFKKHLMDVFQKSCSHIFLYLGRQMPVGALERQLSSNQRSSHSSTLDDIL

SEQ ID NO: 133 - protein, 369 aa, Artificial Sequence
  >sp|P51686|CCR9_HUMAN
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 134 - protein, 369 aa, Artificial Sequence
  >tr|Q0H741|CCR9_MACFA
MTPTEFTSPVPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAVCTMVYPSDESTKLKSAVLTLKVILGFFLPFMVMACCYTIIIHTLIQAKKSSKHKALKVTITVLTVFVLSQFPYNCILLVQTIDAYAMFISSCAVSTNIDICFQVTQTIAFFHSCLNPVLYVFVGERFRRDLVKTLKNLGCISQAQWVSFTRREGSLKLSSMLLETTSGALSL

SEQ ID NO: 135 - protein, 369 aa, Artificial Sequence
  >sp|Q9WUT7|CCR9_MOUSE
MMPTELTSLIPGMFDDFSYDSTASTDDYMNLNFSSFFCKKNNVRQFASHFLPPLYWLVFIVGTLGNSLVILVYWYCTRVKTMTDMFLLNLAIADLLFLATLPFWAIAAAGQWMFQTFMCKVVNSMYKMNFYSCVLLIMCISVDRYIAIVQAMKAQVWRQKRLLYSKMVCITIWVMAAVLCTPEILYSQVSGESGIATCTMVYPKDKNAKLKSAVLILKVTLGFFLPFMVMAFCYTIIIHTLVQAKKSSKHKALKVTITVLTVFIMSQFPYNSILVVQAVDAYAMFISNCTISTNIDICFQVTQTIAFFHSCLNPVLYVFVGERFRRDLVKTLKNLGCISQAQWVSFTRREGSLKLSSMLLETTSGALSL

SEQ ID NO: 136 - protein, 362 aa, Artificial Sequence
  >sp|P46092|CCR10_HUMAN
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 137 - protein, 362 aa, Artificial Sequence
  >tr|A0A2K5UAP1|CCR10_MACFA
MGTEATEQVSWGHYSGDEEEAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSRDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGGCPSGPHRRRGCPRRPRLSSCSAPTETHSLSWDN

SEQ ID NO: 138 - protein, 362 aa, Artificial Sequence
  >sp|Q9JL21|CCR10_MOUSE
MGTKPTEQVSWGLYSGYDEEAYSVGPLPELCYKADVQAFSRAFQPSVSLMVAVLGLAGNGLVLATHLAARRTTRSPTSVHLLQLALADLLLALTLPFAAAGALQGWNLGSTTCRAISGLYSASFHAGFLFLACISADRYVAIARALPAGQRPSTPSRAHLVSVFVWLLSLFLALPALLFSRDGPREGQRRCRLIFPESLTQTVKGASAVAQVVLGFALPLGVMAACYALLGRTLLAARGPERRRALRVVVALVVAFVVLQLPYSLALLLDTADLLAARERSCSSSKRKDLALLVTGGLTLVRCSLNPVLYAFLGLRFRRDLRRLLQGGGCSPKPNPRGRCPRRLRLSSCSAPTETHSLSWDN

SEQ ID NO: 139 - protein, 350 aa, Artificial Sequence
  >sp|P25024|CXCR1_HUMAN
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 140 - protein, 274 aa, Artificial Sequence
  >tr|A0A2K5X9E4|CXCR1_MACFA
MSNATDPQMGDDDYDLNFTGMPPTDEDYSPCRLETQSLNKYVVIVTYALVFLLSLLGNSLVMLVILYRRVGRSVTDVYLLNLAMADLLFALTLPIWAASKAYHPNNATPVCYEVLGNDTAKWRMVLRILPHTFGFTLPLLIMLFCYGFTLHTLFKAHIGQKHRAMRVIFAVVLIFLLCWLPYNLVLLADTLMRTHLIKESCERRNDIGRALDATEILGFLHSCLNPIIYAFIGQNFRHGFLKILATHGLVSKEFLARHHVTSYTSSSVNVSSNL

SEQ ID NO: 141 - protein, 351 aa, Artificial Sequence
  >sp|Q810W6|CXCR1_MOUSE
MAEAEYFIWTNPEGDFEKEFGNITGMLPTGDYFIPCKRVPITNRQALVVFYALVSLLSLLGNSLVMLVILYRRRTRSVMDVYVLNLAIADLLFSLTLPFLAVSKLKGWIFGTPLCKMVSLLKEFNFFSGILLLACISVDRYLAIVHATRTLARKRYLVKFVCVGIWGLSLILSLPFAIFRQAYKPFRSGTVCYEVLGEATTDFRMTLRGLSHIFGFLLPLLTMLVCYGLTLRMLFKTHMRQKHRAMGVIFAVVLVFLLCCLPYNLVLLSDTLLGAHLIEDTCERRNDIDQALYITEILGFSHSCLNPIIYAFVGQNFRHEFLKILANHGLVRKEVLTHRRVAFHTSLTAIY

SEQ ID NO: 142 - protein, 360 aa, Artificial Sequence
  >sp|P25025|CXCR2_HUMAN
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 143 - protein, 353 aa, Artificial Sequence
  >sp|Q28519|CXCR2_MACMU
FNMESDSFEDLWKGEDFSNYSYSSDLPPSLPDVAPCRPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYSLVLLADTLMRTQVIQETCERRNHIDRALDATEILGILHSCLNPLIYAFIGQKFRHGLLKILAIHGLISKDSLPKDSRPSFVGSSSGHT

SEQ ID NO: 144 - protein, 359 aa, Artificial Sequence
  >sp|P35343|CXCR2_MOUSE
MGEFKVDKFNIEDFFSGDLDIFNYSSGMPSILPDAVPCHSENLEINSYAVVVIYVLVTLLSLVGNSLVMLVILYNRSTCSVTDVYLLNLAIADLFFALTLPVWAASKVNGWTFGSTLCKIFSYVKEVTFYSSVLLLACISMDRYLAIVHATSTLIQKRHLVKFVCIAMWLLSVILALPILILRNPVKVNLSTLVCYEDVGNNTSRLRVVLRILPQTFGFLVPLLIMLFCYGFTLRTLFKAHMGQKHRAMRVIFAVVLVFLLCWLPYNLVLFTDTLMRTKLIKETCERRDDIDKALNATEILGFLHSCLNPIIYAFIGQKFRHGLLKIMATYGLVSKEFLAKEGRPSFVSSSSANTSTTL

SEQ ID NO: 145 - protein, 368 aa, Artificial Sequence
  >sp|P49682|CXCR3_HUMAN
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 146 - protein, 368 aa, Artificial Sequence
  >tr|A0A2K5UV19|CXCR3_MACFA
MVLEVSDHQVLNDAEVAALLENFSSSYDYGENESDSCCTSPPCPQDFSLNFDRAFLPALYSLLFLLGLLGNGAVAAVLLSRRAALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 147 - protein, 367 aa, Artificial Sequence
  >sp|O88410|CXCR3_MOUSE
MYLEVSERQVLDASDFAFLLENSTSPYDYGENESDFSDSPPCPQDFSLNFDRTFLPALYSLLFLLGLLGNGAVAAVLLSQRTALSSTDTFLLHLAVADVLLVLTLPLWAVDAAVQWVFGPGLCKVAGALFNINFYAGAFLLACISFDRYLSIVHATQIYRRDPRVRVALTCIVVWGLCLLFALPDFIYLSANYDQRLNATHCQYNFPQVGRTALRVLQLVAGFLLPLLVMAYCYAHILAVLLVSRGQRRFRAMRLVVVVVAAFAVCWTPYHLVVLVDILMDVGVLARNCGRESHVDVAKSVTSGMGYMHCCLNPLLYAFVGVKFREQMWMLFTRLGRSDQRGPQRQPSSSRRESSWSETTEASYLGL

SEQ ID NO: 148 - protein, 352 aa, Artificial Sequence
  >sp|P61073|CXCR4_HUMAN
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 149 - protein, 352 aa, Artificial Sequence
  >sp|Q28474|CXCR4_MACFA
MEGISIYTSDNYTEEMGSGDYDSIKEPCFREENAHFNRIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQKPRKLLAEKVVYVGVWIPALLLTIPDFIFASVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 150 - protein, 359 aa, Artificial Sequence
  >sp|P70658|CXCR4_MOUSE
MEPISVSIYTSDNYSEEVGSGDYDSNKEPCFRDENVHFNRIFLPTIYFIIFLTGIVGNGLVILVMGYQKKLRSMTDKYRLHLSVADLLFVITLPFWAVDAMADWYFGKFLCKAVHIIYTVNLYSSVLILAFISLDRYLAIVHATNSQRPRKLLAEKAVYVGVWIPALLLTIPDFIFADVSQGDISQGDDRYICDRLYPDSLWMVVFQFQHIMVGLILPGIVILSCYCIIISKLSHSKGHQKRKALKTTVILILAFFACWLPYYVGISIDSFILLGVIKQGCDFESIVHKWISITEALAFFHCCLNPILYAFLGAKFKSSAQHALNSMSRGSSLKILSKGKRGGHSSVSTESESSSFHSS

SEQ ID NO: 151 - protein, 372 aa, Artificial Sequence
  >sp|P32302|CXCR5_HUMAN
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 152 - protein, 372 aa, Artificial Sequence
  >tr|G8F5K4|CXCR5_MACFA
MNYPLMLEMDLENLEDLFLEFDKFDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLFALPEILFAKVSQAHPNNSLPRCTFSQENQAETHAWFTSRFLYHVAGFLLPMLVMGWCYVGVVHRLRQAQRRPQRQKAVRVAILVTSIFFLCWSPYHIVIFLDTLVRLKAVDNTCELNGSLPVAITMCEFLGLAHCCLNPMLYTFAGVKFRSDLSRLLTKLGCTGPASLCQLFPSWRKSSLSESENATSLTTF

SEQ ID NO: 153 - protein, 374 aa, Artificial Sequence
  >sp|Q04683|CXCR5_MOUSE
MNYPLTLDMGSITYNMDDLYKELAFYSNSTEIPLQDSNFCSTVEGPLLTSFKAVFMPVAYSLIFLLGMMGNILVLVILERHRHTRSSTETFLFHLAVADLLLVFILPFAVAEGSVGWVLGTFLCKTVIALHKINFYCSSLLLACIAVDRYLAIVHAVHAYRRRRLLSIHITCTAIWLAGFLFALPELLFAKVGQPHNNDSLPQCTFSQENEAETRAWFTSRFLYHIGGFLLPMLVMGWCYVGVVHRLLQAQRRPQRQKAVRVAILVTSIFFLCWSPYHIVIFLDTLERLKAVNSSCELSGYLSVAITLCEFLGLAHCCLNPMLYTFAGVKFRSDLSRLLTKLGCAGPASLCQLFPNWRKSSLSESENATSLTTF

SEQ ID NO: 154 - protein, 342 aa, Artificial Sequence
  >sp|O00574|CXCR6_HUMAN
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 155 - protein, 343 aa, Artificial Sequence
  >sp|Q9BDS6|CXCR6_MACFA
MAEYDHYEDDGFLNSFNDSSQEEHQDFLQFRKVFLPCMYLVVFVCGLVGNSLVLVISIFYHKLQSLTDVFLVNLPLADLVFVCTLPFWTYAGIHEWIFGQVMCKTLLGVYTINFYTSMLILTCITVDRFIVVVKATKAYNQQAKRMTWGKVICLLIWVISLLVSLPQIIYGNVFNLDKLICGYHDEEISTVVLATQMTLGFFLPLLAMIVCYSVIIKTLLHAGGFQKHRSLKIIFLVMAVFLLTQTPFNLVKLIRSTRWEYYAMTSFHYTIIVTEAIAYLRACLNPVLYAFVSLKFRKNFWKLVKDIGCLPYLGVSHQWKSSEDNSKTFSASHNVEATSMFQL

SEQ ID NO: 156 - protein, 351 aa, Artificial Sequence
  >sp|Q9EQ16|CXCR6_MOUSE
MDDGHQESALYDGHYEGDFWLFNNSSDNSQENKRFLKFKEVFLPCVYLVVFVFGLLGNSLVLIIYIFYQKLRTLTDVFLLNLPLADLVFVCTLPFWAYAGTYEWVFGTVMCKTLRGMYTMNFYVSMLTLTCITVDRFIVVVQATKAFNRQAKWKIWGQVICLLIWVVSLLVSLPQIIYGHVQDIDKLICQYHSEEISTMVLVIQMTLGFFLPLLTMILCYSGIIKTLLHARNFQKHKSLKIIFLVVAVFLLTQTPFNLAMLIQSTSWEYYTITSFKYAIVVTEAIAYFRACLNPVLYAFVGLKFRKNVWKLMKDIGCLSHLGVSSQWKSSEDSSKTCSASHNVETTSMFQL

SEQ ID NO: 157 - protein, 20 aa, Artificial Sequence
  >sp|P49238|CX3CR1_HUMAN_TRD
MDQFPESVTENFEYDDLAEA

SEQ ID NO: 158 - protein, 20 aa, Artificial Sequence
  >sp|Q6Y3J6|CX3CR1_MACFA_TRD
LRNVEANFLGFLLPLLIMSY

SEQ ID NO: 159 - protein, 21 aa, Artificial Sequence
  >sp|Q9Z0D9|CX3CR1_MOUSE_TRD
MSTSFPELDLENFEYDDSAEA

SEQ ID NO: 160 - protein, 31 aa, Artificial Sequence
  >sp|P49238|CX3CR1_HUMAN_N term
  misc_feature (21)..(21): Xaa can be any naturally occurring amino acid
MDQFPESVTENFEYDDLAEAXYIGDIVVFGT

SEQ ID NO: 161 - protein, 31 aa, Artificial Sequence
  >sp|Q6Y3J6|CX3CR1_MACFA_N term
  misc_feature (21)..(21): Xaa can be any naturally occurring amino acid
LRNVEANFLGFLLPLLIMSYXYFRIIQTLFS

SEQ ID NO: 162 - protein, 32 aa, Artificial Sequence
  >sp|Q9Z0D9|CX3CR1_MOUSE_N term
  misc_feature (22)..(22): Xaa can be any naturally occurring amino acid
MSTSFPELDLENFEYDDSAEAXYLGDIVAFGT

SEQ ID NO: 163 - protein, 29 aa, Artificial Sequence
  >sp|P25024|CXCR1_HUMAN_TRD
MSNITDPQMWDFDDLNFTGMPPADEDYSP

SEQ ID NO: 164 - protein, 30 aa, Artificial Sequence; identical to SEQ ID NO: 74
  >sp|Q2YEG0|CXCR1_MACMU_TRD

SEQ ID NO: 165 - protein, 35 aa, Artificial Sequence; identical to SEQ ID NO: 75
  >sp|Q810W6|CXCR1_MOUSE_TRD

SEQ ID NO: 166 - protein, 39 aa, Artificial Sequence; identical to SEQ ID NO: 76
  >sp|P25024|CXCR1_HUMAN_N term
  misc_feature (30)..(30): Xaa can be any naturally occurring amino acid

SEQ ID NO: 167 - protein, 46 aa, Artificial Sequence
  >sp|Q2YEG0|CXCR1_MACMU_N term
  misc_feature (31)..(31): Xaa can be any naturally occurring amino acid
MSNATDPQMGDDDYDLNFTGMPPTDEDYSPXRLETQSLNKYVVIVT

SEQ ID NO: 168 - protein, 44 aa, Artificial Sequence; identical to SEQ ID NO: 78
  >sp|Q810W6|CXCR1_MOUSE_N term
  misc_feature (36)..(36): Xaa can be any naturally occurring amino acid

SEQ ID NO: 169-200 - skipped (32 entries)

SEQ ID NO: 201 - protein, 115 aa, Artificial Sequence
  TPP-14095_497A-M005-E07 -hIgG1Lambda_VH
EVQLLESGGGLVQPGGSLRLSCAASGFTFSSYGMHWVRQAPGKGLEWVSAISGSGGSTYYADSVKGRFTISRDNSKNTLYLQMNSLRAEDTAVYYCARGRQLGSWGQGTLVTVSS

SEQ ID NO: 202 - protein, 5 aa, Artificial Sequence
  TPP-14095_497A-M005-E07 -hIgG1Lambda_HCDR1
SYGMH

SEQ ID NO: 203 - protein, 17 aa, Artificial Sequence
  TPP-14095_497A-M005-E07 -hIgG1Lambda_HCDR2
AISGSGGSTYYADSVKG

SEQ ID NO: 204 - protein, 6 aa, Artificial Sequence
  TPP-14095_497A-M005-E07 -hIgG1Lambda_HCDR3
GRQLGS

SEQ ID NO: 205 - protein, 110 aa, Artificial Sequence
  TPP-14095_497A-M005-E07 -hIgG1Lambda_VL
QSVLTQPPSASGTPGQRVTISCSGSSSNIGSNYVYWYQQLPGTAPKLLIYGNNNRPSGVPDRFSGSKSGTSASLAISGLRSEDEADYYCAAWDDSLNGWVFGGGTKLTVL

SEQ ID NO: 206 - protein, 13 aa, Artificial Sequence
  TPP-14095_497A-M005-E07 -hIgG1Lambda_LCDR1
SGSSSNIGSNYVY

SEQ ID NO: 207 - protein, 7 aa, Artificial Sequence
  TPP-14095_497A-M005-E07 -hIgG1Lambda_LCDR2
GNNNRPS

SEQ ID NO: 208 - protein, 11 aa, Artificial Sequence
  TPP-14095_497A-M005-E07 -hIgG1Lambda_LCDR3
AAWDDSLNGWV

SEQ ID NO: 209 - DNA, 345 bp, Artificial Sequence
  TPP-14095_497A-M005-E07 -hIgG1Lambda_VH
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccatctctggcagcggcggcagcacatattacgccgattctgtgaagggcagattcaccatcagccgggacaacagcaagaacaccctgtacctgcagatgaacagcctgagagccgaggacaccgccgtgtactattgtgccagaggcagacagctcggctcttggggacagggaacactggttacagtgtcctca

SEQ ID NO: 210 - DNA, 330 bp, Artificial Sequence
  TPP-14095_497A-M005-E07 -hIgG1Lambda_VL
cagtctgttctgacacagcctcctagcgcctctggcacacctggacagagagtgaccatcagctgtagcggcagcagctccaacatcggcagcaactacgtgtactggtatcagcagctgcccggcacagcccctaaactgctgatctacggcaacaacaacagacccagcggcgtgcccgatagattcagcggctctaagtctggcacaagcgccagcctggccatctctggactgagatctgaggacgaggccgactactattgcgccgcctgggacgattctctgaacggctgggttttcggcggaggcaccaaactgacagtgcta

SEQ ID NO: 211 - protein, 444 aa, Artificial Sequence
  TPP-14095_497A-M005-E07 -hIgG1Lambda_Heavy Chain
EVQLLESGGGLVQPGGSLRLSCAASGFTFSSYGMHWVRQAPGKGLEWVSAISGSGGSTYYADSVKGRFTISRDNSKNTLYLQMNSLRAEDTAVYYCARGRQLGSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 212 - protein, 216 aa, Artificial Sequence
  TPP-14095_497A-M005-E07 -hIgG1Lambda_Light Chain
QSVLTQPPSASGTPGQRVTISCSGSSSNIGSNYVYWYQQLPGTAPKLLIYGNNNRPSGVPDRFSGSKSGTSASLAISGLRSEDEADYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 213 - DNA, 1332 bp, Artificial Sequence
  TPP-14095_497A-M005-E07 -hIgG1Lambda_Heavy Chain
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccatctctggcagcggcggcagcacatattacgccgattctgtgaagggcagattcaccatcagccgggacaacagcaagaacaccctgtacctgcagatgaacagcctgagagccgaggacaccgccgtgtactattgtgccagaggcagacagctcggctcttggggacagggaacactggttacagtgtcctcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggc

SEQ ID NO: 214 - DNA, 648 bp, Artificial Sequence
  TPP-14095_497A-M005-E07 -hIgG1Lambda_Light Chain
cagtctgttctgacacagcctcctagcgcctctggcacacctggacagagagtgaccatcagctgtagcggcagcagctccaacatcggcagcaactacgtgtactggtatcagcagctgcccggcacagcccctaaactgctgatctacggcaacaacaacagacccagcggcgtgcccgatagattcagcggctctaagtctggcacaagcgccagcctggccatctctggactgagatctgaggacgaggccgactactattgcgccgcctgggacgattctctgaacggctgggttttcggcggaggcaccaaactgacagtgctaggccagcctaaagccgcccctagcgtgaccctgttccctccaagcagcgaggaactgcaggccaacaaggccaccctcgtgtgcctgatcagcgacttctatcctggcgccgtgaccgtggcctggaaggccgatagctctcctgtgaaggccggcgtggaaaccaccacccctagcaagcagagcaacaacaaatacgccgccagcagctacctgagcctgacccccgagcagtggaagtcccacagatcctacagctgccaagtgacccacgagggcagcaccgtggaaaagacagtggcccctaccgagtgcagc

SEQ ID NO: 215 - protein, 112 aa, Artificial Sequence
  TPP-14099_497A-M005-F02 -hIgG1Lambda_VH
EVQLLESGGGLVQPGGSLRLSCAASGFTFSDYGVHWVRQAPGKGLEWVSGVSWNGSRTHYADSVKGRFTISRDNSKNTLYLQMNSLRAEDTAVYYCVTRGAWGQGTLVTVSS

SEQ ID NO: 216 - protein, 5 aa, Artificial Sequence
  TPP-14099_497A-M005-F02 -hIgG1Lambda_HCDR1
DYGVH

SEQ ID NO: 217 - protein, 17 aa, Artificial Sequence
  TPP-14099_497A-M005-F02 -hIgG1Lambda_HCDR2
GVSWNGSRTHYADSVKG

SEQ ID NO: 218 - skipped

SEQ ID NO: 219 - protein, 110 aa, Artificial Sequence
  TPP-14099_497A-M005-F02 -hIgG1Lambda_VL
QSVLTQPPSASGTPGQRVTISCSGSSFNIGSHFVYWYQQLPGTAPKLLIYKNNQRPSGVPDRFSGSKSGTSASLAISGLRSEDEADYYCAAWDDSLNGPVFGGGTKLTVL

SEQ ID NO: 220 - protein, 13 aa, Artificial Sequence
  TPP-14099_497A-M005-F02 -hIgG1Lambda_LCDR1
SGSSFNIGSHFVY

SEQ ID NO: 221 - protein, 7 aa, Artificial Sequence
  TPP-14099_497A-M005-F02 -hIgG1Lambda_LCDR2
KNNQRPS

SEQ ID NO: 222 - protein, 11 aa, Artificial Sequence
  TPP-14099_497A-M005-F02 -hIgG1Lambda_LCDR3
AAWDDSLNGPV

SEQ ID NO: 223 - DNA, 336 bp, Artificial Sequence
  TPP-14099_497A-M005-F02 -hIgG1Lambda_VH
gaagttcagctgctggaatctggcggcggactggttcaacctggcggatctctgagactgagctgtgccgccagcggcttcacctttagcgattatggcgtgcactgggtccgacaggcccctggaaaaggactggaatgggtttcaggcgtgtcctggaacggcagcagaacccactatgccgacagcgtgaagggcagattcaccatcagccgggacaacagcaagaacaccctgtacctgcagatgaacagcctgagagccgaggacaccgccgtgtactactgtgtgacaagaggcgcttggggccagggcacactggtcacagtttcttca

SEQ ID NO: 224 - DNA, 330 bp, Artificial Sequence
  TPP-14099_497A-M005-F02 -hIgG1Lambda_VL
cagtctgttctgacacagcctcctagcgcctctggcacacctggacagagagtgaccatcagctgtagcggcagcagcttcaacatcggcagccacttcgtgtactggtatcagcagctgcctggcacagcccctaaactgctgatctacaagaacaaccagcggcctagcggcgtgcccgatagattttctggcagcaagagcggcacaagcgccagcctggctatctctggactgagatctgaggacgaggccgactactattgcgccgcctgggacgattctctgaacggccctgtttttggcggaggcaccaagctgacagtgcta

SEQ ID NO: 225 - protein, 441 aa, Artificial Sequence
  TPP-14099_497A-M005-F02 -hIgG1Lambda_Heavy Chain
EVQLLESGGGLVQPGGSLRLSCAASGFTFSDYGVHWVRQAPGKGLEWVSGVSWNGSRTHYADSVKGRFTISRDNSKNTLYLQMNSLRAEDTAVYYCVTRGAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - protein, 216 aa, Artificial Sequence
  TPP-14099_497A-M005-F02 -hIgG1Lambda_Light Chain
QSVLTQPPSASGTPGQRVTISCSGSSFNIGSHFVYWYQQLPGTAPKLLIYKNNQRPSGVPDRFSGSKSGTSASLAISGLRSEDEADYYCAAWDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 227 - DNA, 1323 bp, Artificial Sequence
  TPP-14099_497A-M005-F02 -hIgG1Lambda_Heavy Chain
gaagttcagctgctggaatctggcggcggactggttcaacctggcggatctctgagactgagctgtgccgccagcggcttcacctttagcgattatggcgtgcactgggtccgacaggcccctggaaaaggactggaatgggtttcaggcgtgtcctggaacggcagcagaacccactatgccgacagcgtgaagggcagattcaccatcagccgggacaacagcaagaacaccctgtacctgcagatgaacagcctgagagccgaggacaccgccgtgtactactgtgtgacaagaggcgcttggggccagggcacactggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggc

SEQ ID NO: 228 - DNA, 648 bp, Artificial Sequence
  TPP-14099_497A-M005-F02 -hIgG1Lambda_Light Chain
cagtctgttctgacacagcctcctagcgcctctggcacacctggacagagagtgaccatcagctgtagcggcagcagcttcaacatcggcagccacttcgtgtactggtatcagcagctgcctggcacagcccctaaactgctgatctacaagaacaaccagcggcctagcggcgtgcccgatagattttctggcagcaagagcggcacaagcgccagcctggctatctctggactgagatctgaggacgaggccgactactattgcgccgcctgggacgattctctgaacggccctgtttttggcggaggcaccaagctgacagtgctaggccagcctaaagccgcccctagcgtgaccctgttccctccaagcagcgaggaactgcaggccaacaaggccaccctcgtgtgcctgatcagcgacttctatcctggcgccgtgaccgtggcctggaaggccgatagctctcctgtgaaggccggcgtggaaaccaccacccctagcaagcagagcaacaacaaatacgccgccagcagctacctgagcctgacccccgagcagtggaagtcccacagatcctacagctgccaagtgacccacgagggcagcaccgtggaaaagacagtggcccctaccgagtgcagc

SEQ ID NO: 229 - protein, 112 aa, Artificial Sequence; identical to SEQ ID NO: 215
  TPP-15285_497A-M005-F02-mIgG2aLambda_VH

SEQ ID NO: 230 - protein, 5 aa, Artificial Sequence
  TPP-15285_497A-M005-F02-mIgG2aLambda_HCDR1
DYGVH

SEQ ID NO: 231 - protein, 17 aa, Artificial Sequence
  TPP-15285_497A-M005-F02-mIgG2aLambda_HCDR2
GVSWNGSRTHYADSVKG

SEQ ID NO: 232 - skipped

SEQ ID NO: 233 - protein, 110 aa, Artificial Sequence; identical to SEQ ID NO: 219
  TPP-15285_497A-M005-F02-mIgG2aLambda_VL

SEQ ID NO: 234 - protein, 13 aa, Artificial Sequence
  TPP-15285_497A-M005-F02-mIgG2aLambda_LCDR1
SGSSFNIGSHFVY

SEQ ID NO: 235 - protein, 7 aa, Artificial Sequence
  TPP-15285_497A-M005-F02-mIgG2aLambda_LCDR2
KNNQRPS

SEQ ID NO: 236 - protein, 11 aa, Artificial Sequence
  TPP-15285_497A-M005-F02-mIgG2aLambda_LCDR3
AAWDDSLNGPV

SEQ ID NO: 237 - DNA, 336 bp, Artificial Sequence; identical to SEQ ID NO: 223
  TPP-15285_497A-M005-F02-mIgG2aLambda_VH

SEQ ID NO: 238 - DNA, 330 bp, Artificial Sequence; identical to SEQ ID NO: 224
  TPP-15285_497A-M005-F02-mIgG2aLambda_VL

SEQ ID NO: 239 - protein, 442 aa, Artificial Sequence
  TPP-15285_497A-M005-F02-mIgG2aLambda_Heavy Chain
EVQLLESGGGLVQPGGSLRLSCAASGFTFSDYGVHWVRQAPGKGLEWVSGVSWNGSRTHYADSVKGRFTISRDNSKNTLYLQMNSLRAEDTAVYYCVTRGAWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 240 - protein, 216 aa, Artificial Sequence
  TPP-15285_497A-M005-F02-mIgG2aLambda_Light Chain
QSVLTQPPSASGTPGQRVTISCSGSSFNIGSHFVYWYQQLPGTAPKLLIYKNNQRPSGVPDRFSGSKSGTSASLAISGLRSEDEADYYCAAWDDSLNGPVFGGGTKLTVLGQPKSSPSVTLFPPSSEELETNKATLVCTITDFYPGVVTVDWKVDGTPVTQGMETTQPSKQSNNKYMASSYLTLTARAWERHSSYSCQVTHEGHTVEKSLSRADCS

SEQ ID NO: 241 - DNA, 1326 bp, Artificial Sequence
  TPP-15285_497A-M005-F02-mIgG2aLambda_Heavy Chain
gaagttcagctgctggaatctggcggcggactggttcaacctggcggatctctgagactgagctgtgccgccagcggcttcacctttagcgattatggcgtgcactgggtccgacaggcccctggaaaaggactggaatgggtttcaggcgtgtcctggaacggcagcagaacccactatgccgacagcgtgaagggcagattcaccatcagccgggacaacagcaagaacaccctgtacctgcagatgaacagcctgagagccgaggacaccgccgtgtactactgtgtgacaagaggcgcttggggccagggcacactggtcacagtttcttcagccaagaccaccgcccccagcgtgtaccctctggctcctgtgtgtggcgataccaccggcagctctgtgaccctgggctgcctcgtgaagggctacttccctgagccagtgaccctgacctggaacagcggctctctgtctagcggcgtgcacacctttccagccgtgctgcagagcgacctgtacaccctgagcagcagcgtgaccgtgaccagcagcacatggcccagccagagcatcacctgtaacgtggcccaccctgccagctccaccaaggtggacaagaagatcgagcccagaggccccaccatcaagccttgccccccttgcaaatgccctgcccccaatctgctgggcggaccctccgtgttcatcttcccacccaagatcaaggacgtgctgatgatcagcctgagccccatcgtgacctgcgtggtggtggacgtgtccgaggacgaccccgatgtgcagatcagttggttcgtgaacaacgtggaagtgcacaccgcccagacccagacacacagagaggactacaacagcaccctgagagtggtgtccgccctgcccatccagcaccaggattggatgagcggcaaagagttcaagtgcaaagtgaacaacaaggacctgccagcccccatcgagcggaccatctctaagcctaagggcagcgtgcgggctccccaggtgtacgtgctgcctcctccagaggaagagatgaccaagaaacaagtgacactgacatgcatggtcaccgacttcatgcccgaggacatctacgtggaatggaccaacaacggcaagaccgagctgaactacaagaacaccgagcccgtgctggacagcgacggcagctacttcatgtacagcaagctgcgggtggaaaagaaaaactgggtggaacggaacagctacagctgcagcgtggtgcacgagggcctgcacaatcaccacaccaccaagagcttcagccggacccctggcaag

SEQ ID NO: 242 - DNA, 648 bp, Artificial Sequence
  TPP-15285_497A-M005-F02-mIgG2aLambda_Light Chain
cagtctgttctgacacagcctcctagcgcctctggcacacctggacagagagtgaccatcagctgtagcggcagcagcttcaacatcggcagccacttcgtgtactggtatcagcagctgcctggcacagcccctaaactgctgatctacaagaacaaccagcggcctagcggcgtgcccgatagattttctggcagcaagagcggcacaagcgccagcctggctatctctggactgagatctgaggacgaggccgactactattgcgccgcctgggacgattctctgaacggccctgtttttggcggaggcaccaagctgacagtgctaggccagcccaagagcagccctagcgtgaccctgttccctccaagcagcgaggaactggaaacaaacaaggccaccctcgtgtgcaccatcaccgacttctaccccggcgtcgtgaccgtggactggaaggtggacggcaccccagtgacccagggcatggaaaccacccagcccagcaagcagagcaacaacaagtacatggccagcagctacctgaccctgaccgccagagcctgggagagacacagctcctacagctgccaagtgacccacgagggccacaccgtggaaaagagcctgagcagagccgactgcagc

SEQ ID NO: 243 - protein, 115 aa, Artificial Sequence; identical to SEQ ID NO: 201
  TPP-15286_497A-M005-E07-mIgG2aLambda_VH

SEQ ID NO: 244 - protein, 5 aa, Artificial Sequence
  TPP-15286_497A-M005-E07-mIgG2aLambda_HCDR1
SYGMH

SEQ ID NO: 245 - protein, 17 aa, Artificial Sequence
  TPP-15286_497A-M005-E07-mIgG2aLambda_HCDR2
AISGSGGSTYYADSVKG

SEQ ID NO: 246 - protein, 6 aa, Artificial Sequence
  TPP-15286_497A-M005-E07-mIgG2aLambda_HCDR3
GRQLGS

SEQ ID NO: 247 - protein, 110 aa, Artificial Sequence; identical to SEQ ID NO: 205
  TPP-15286_497A-M005-E07-mIgG2aLambda_VL

SEQ ID NO: 248 - protein, 13 aa, Artificial Sequence
  TPP-15286_497A-M005-E07-mIgG2aLambda_LCDR1
SGSSSNIGSNYVY

SEQ ID NO: 249 - protein, 7 aa, Artificial Sequence
  TPP-15286_497A-M005-E07-mIgG2aLambda_LCDR2
GNNNRPS

SEQ ID NO: 250 - protein, 11 aa, Artificial Sequence
  TPP-15286_497A-M005-E07-mIgG2aLambda_LCDR3
AAWDDSLNGWV

SEQ ID NO: 251 - DNA, 345 bp, Artificial Sequence; identical to SEQ ID NO: 209
  TPP-15286_497A-M005-E07-mIgG2aLambda_VH

SEQ ID NO: 252 - DNA, 330 bp, Artificial Sequence; identical to SEQ ID NO: 210
  TPP-15286_497A-M005-E07-mIgG2aLambda_VL

SEQ ID NO: 253 - protein, 445 aa, Artificial Sequence
  TPP-15286_497A-M005-E07-mIgG2aLambda_Heavy Chain
EVQLLESGGGLVQPGGSLRLSCAASGFTFSSYGMHWVRQAPGKGLEWVSAISGSGGSTYYADSVKGRFTISRDNSKNTLYLQMNSLRAEDTAVYYCARGRQLGSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 254 - protein, 216 aa, Artificial Sequence
  TPP-15286_497A-M005-E07-mIgG2aLambda_Light Chain
QSVLTQPPSASGTPGQRVTISCSGSSSNIGSNYVYWYQQLPGTAPKLLIYGNNNRPSGVPDRFSGSKSGTSASLAISGLRSEDEADYYCAAWDDSLNGWVFGGGTKLTVLGQPKSSPSVTLFPPSSEELETNKATLVCTITDFYPGVVTVDWKVDGTPVTQGMETTQPSKQSNNKYMASSYLTLTARAWERHSSYSCQVTHEGHTVEKSLSRADCS

SEQ ID NO: 255 - DNA, 1335 bp, Artificial Sequence
  TPP-15286_497A-M005-E07-mIgG2aLambda_Heavy Chain
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccatctctggcagcggcggcagcacatattacgccgattctgtgaagggcagattcaccatcagccgggacaacagcaagaacaccctgtacctgcagatgaacagcctgagagccgaggacaccgccgtgtactattgtgccagaggcagacagctcggctcttggggacagggaacactggttacagtgtcctcagccaagaccaccgcccccagcgtgtaccctctggctcctgtgtgtggcgataccaccggcagctctgtgaccctgggctgcctcgtgaagggctacttccctgagccagtgaccctgacctggaacagcggctctctgtctagcggcgtgcacacctttccagccgtgctgcagagcgacctgtacaccctgagcagcagcgtgaccgtgaccagcagcacatggcccagccagagcatcacctgtaacgtggcccaccctgccagctccaccaaggtggacaagaagatcgagcccagaggccccaccatcaagccttgccccccttgcaaatgccctgcccccaatctgctgggcggaccctccgtgttcatcttcccacccaagatcaaggacgtgctgatgatcagcctgagccccatcgtgacctgcgtggtggtggacgtgtccgaggacgaccccgatgtgcagatcagttggttcgtgaacaacgtggaagtgcacaccgcccagacccagacacacagagaggactacaacagcaccctgagagtggtgtccgccctgcccatccagcaccaggattggatgagcggcaaagagttcaagtgcaaagtgaacaacaaggacctgccagcccccatcgagcggaccatctctaagcctaagggcagcgtgcgggctccccaggtgtacgtgctgcctcctccagaggaagagatgaccaagaaacaagtgacactgacatgcatggtcaccgacttcatgcccgaggacatctacgtggaatggaccaacaacggcaagaccgagctgaactacaagaacaccgagcccgtgctggacagcgacggcagctacttcatgtacagcaagctgcgggtggaaaagaaaaactgggtggaacggaacagctacagctgcagcgtggtgcacgagggcctgcacaatcaccacaccaccaagagcttcagccggacccctggcaag

SEQ ID NO: 256 - DNA, 648 bp, Artificial Sequence
  TPP-15286_497A-M005-E07-mIgG2aLambda_Light Chain
cagtctgttctgacacagcctcctagcgcctctggcacacctggacagagagtgaccatcagctgtagcggcagcagctccaacatcggcagcaactacgtgtactggtatcagcagctgcccggcacagcccctaaactgctgatctacggcaacaacaacagacccagcggcgtgcccgatagattcagcggctctaagtctggcacaagcgccagcctggccatctctggactgagatctgaggacgaggccgactactattgcgccgcctgggacgattctctgaacggctgggttttcggcggaggcaccaaactgacagtgctaggccagcccaagagcagccctagcgtgaccctgttccctccaagcagcgaggaactggaaacaaacaaggccaccctcgtgtgcaccatcaccgacttctaccccggcgtcgtgaccgtggactggaaggtggacggcaccccagtgacccagggcatggaaaccacccagcccagcaagcagagcaacaacaagtacatggccagcagctacctgaccctgaccgccagagcctgggagagacacagctcctacagctgccaagtgacccacgagggccacaccgtggaaaagagcctgagcagagccgactgcagc

SEQ ID NO: 257 - protein, 119 aa, Artificial Sequence
  TPP-16966_15291-deglyco-hIgG1Lambda_VH
EVQLLESGGGLVQPGGSLRLSCAASGFTFSSYSMNWVRQAPGKGLEWVSGVSWAGSRTHYADSVKGRFTISRDNSKNTLYLQMNSLRAEDTAVYYCARAAAGTRGFDYWGQGTLVTVSS

SEQ ID NO: 258 - protein, 5 aa, Artificial Sequence
  TPP-16966_15291-deglyco-hIgG1Lambda_HCDR1
SYSMN

SEQ ID NO: 259 - protein, 17 aa, Artificial Sequence
  TPP-16966_15291-deglyco-hIgG1Lambda_HCDR2
GVSWAGSRTHYADSVKG

SEQ ID NO: 260 - protein, 10 aa, Artificial Sequence
  TPP-16966_15291-deglyco-hIgG1Lambda_HCDR3
AAAGTRGFDY

SEQ ID NO: 261 - protein, 109 aa, Artificial Sequence
  TPP-16966_15291-deglyco-hIgG1Lambda_VL
QSVLTQPPSASGTPGQRVTISCSGSSSNIGSHIVNWYQQLPGTAPKLLIYGNTNRPSGVPDRFSGSKSGTSASLAISGLRSEDEADYYCSSYTSISTLVFGGGTKLTVL

SEQ ID NO: 262 - protein, 13 aa, Artificial Sequence
  TPP-16966_15291-deglyco-hIgG1Lambda_LCDR1
SGSSSNIGSHIVN

SEQ ID NO: 263 - protein, 7 aa, Artificial Sequence
  TPP-16966_15291-deglyco-hIgG1Lambda_LCDR2
GNTNRPS

SEQ ID NO: 264 - protein, 10 aa, Artificial Sequence
  TPP-16966_15291-deglyco-hIgG1Lambda_LCDR3
SSYTSISTLV

SEQ ID NO: 265 - DNA, 357 bp, Artificial Sequence
  TPP-16966_15291-deglyco-hIgG1Lambda_VH
gaagttcagctgctggaatctggcggcggactggttcaacctggcggatctctgagactgagctgtgccgccagcggcttcacctttagcagctacagcatgaactgggtccgacaggcccctggcaaaggccttgaatgggtttcaggcgtgtcctgggccggcagcagaacccactatgccgacagcgtgaagggcagattcaccatcagccgggacaacagcaagaacaccctgtacctgcagatgaacagcctgagagccgaggacaccgccgtgtactattgtgccagagctgccgccggaaccagaggctttgattattggggccagggcaccctggtcaccgtttcttca

SEQ ID NO: 266 - DNA, 15 bp, Artificial Sequence
  TPP-16966_15291-deglyco-hIgG1Lambda_HCDR1
agctacagcatgaac

SEQ ID NO: 267 - DNA, 51 bp, Artificial Sequence
  TPP-16966_15291-deglyco-hIgG1Lambda_HCDR2
ggcgtgtcctgggccggcagcagaacccactatgccgacagcgtgaagggc

SEQ ID NO: 268 - DNA, 30 bp, Artificial Sequence
  TPP-16966_15291-deglyco-hIgG1Lambda_HCDR3
gctgccgccggaaccagaggctttgattat

SEQ ID NO: 269 - DNA, 327 bp, Artificial Sequence
  TPP-16966_15291-deglyco-hIgG1Lambda_VL
cagtctgttctgacacagcctcctagcgcctctggcacacctggacagagagtgaccatcagctgtagcggcagcagctccaatatcggcagccacatcgtgaactggtatcagcagctgcctggcacagcccctaaactgctgatctacggcaacaccaacagacccagcggcgtgcccgatagattttccggctctaagagcggcacaagcgccagcctggctatctctggactgagatctgaggacgaggccgactactactgcagcagctacaccagcatcagcaccctggtttttggcggaggcaccaagctgacagtgcta

SEQ ID NO: 270 - DNA, 39 bp, Artificial Sequence
  TPP-16966_15291-deglyco-hIgG1Lambda_LCDR1
agcggcagcagctccaatatcggcagccacatcgtgaac

SEQ ID NO: 271 - DNA, 21 bp, Artificial Sequence
  TPP-16966_15291-deglyco-hIgG1Lambda_LCDR2
ggcaacaccaacagacccagc

SEQ ID NO: 272 - DNA, 30 bp, Artificial Sequence
  TPP-16966_15291-deglyco-hIgG1Lambda_LCDR3
agcagctacaccagcatcagcaccctggtt

SEQ ID NO: 273 - protein, 448 aa, Artificial Sequence
  TPP-16966_15291-deglyco-hIgG1Lambda_Heavy Chain
EVQLLESGGGLVQPGGSLRLSCAASGFTFSSYSMNWVRQAPGKGLEWVSGVSWAGSRTHYADSVKGRFTISRDNSKNTLYLQMNSLRAEDTAVYYCARAAAGTRGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 274 - protein, 215 aa, Artificial Sequence
  TPP-16966_15291-deglyco-hIgG1Lambda_Light Chain
QSVLTQPPSASGTPGQRVTISCSGSSSNIGSHIVNWYQQLPGTAPKLLIYGNTNRPSGVPDRFSGSKSGTSASLAISGLRSEDEADYYCSSYTSISTLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 275 - protein, 120 aa, Artificial Sequence
  TPP-17575_497A-M181-C17-1-hIgG1Lambda_VH
EVQLLESGGGLVQPGGSLRLSCAASGFTFRSYAMHWVRQAPGKGLEWVSLISWDGGSTYYADSVKGRFTISRDNSKNTLYLQMNSLRAEDTAVYYCARGGIGRRPGLEYWGQGTLVTVSS

SEQ ID NO: 276 - protein, 5 aa, Artificial Sequence
  TPP-17575_497A-M181-C17-1-hIgG1Lambda_HCDR1
SYAMH

SEQ ID NO: 277 - protein, 17 aa, Artificial Sequence
  TPP-17575_497A-M181-C17-1-hIgG1Lambda_HCDR2
LISWDGGSTYYADSVKG

SEQ ID NO: 278 - protein, 11 aa, Artificial Sequence
  TPP-17575_497A-M181-C17-1-hIgG1Lambda_HCDR3
GGIGRRPGLEY

SEQ ID NO: 279 - protein, 108 aa, Artificial Sequence
  TPP-17575_497A-M181-C17-1-hIgG1Lambda_VL
QSVLTQPPSASGTPGQRVTISCSGSSSNIGNNYVSWYQQLPGTAPKLLIYGNSNRPSGVPDRFSGSKSGTSASLAISGLRSEDEADYYCQTWGTGIRVFGGGTKLTVL

SEQ ID NO: 280 - protein, 13 aa, Artificial Sequence
  TPP-17575_497A-M181-C17-1-hIgG1Lambda_LCDR1
SGSSSNIGNNYVS

SEQ ID NO: 281 - protein, 7 aa, Artificial Sequence
  TPP-17575_497A-M181-C17-1-hIgG1Lambda_LCDR2
GNSNRPS

SEQ ID NO: 282 - protein, 9 aa, Artificial Sequence
  TPP-17575_497A-M181-C17-1-hIgG1Lambda_LCDR3
QTWGTGIRV

SEQ ID NO: 283 - DNA, 360 bp, Artificial Sequence
  TPP-17575_497A-M181-C17-1-hIgG1Lambda_VH
gaggtgcagctgttggagtctgggggaggcttggtacagcctggggggtccctgagactctcctgtgcagcctctggattcaccttcaggagctatgctatgcactgggtccgccaggctccaggcaaggggctggagtgggtctctcttattagttgggatggtggtagcacctactatgcagactctgtgaagggtcgattcaccatctccagagacaattccaagaacacgctgtatctgcaaatgaacagcctgagagccgaggacactgccgtgtattactgtgcgagagggggtatagggcgtcgtcctgggcttgagtactggggccaaggtaccctggtcaccgtgagttca

SEQ ID NO: 284 - DNA, 15 bp, Artificial Sequence
  TPP-17575_497A-M181-C17-1-hIgG1Lambda_HCDR1
agctatgctatgcac

SEQ ID NO: 285 - DNA, 51 bp, Artificial Sequence
  TPP-17575_497A-M181-C17-1-hIgG1Lambda_HCDR2
cttattagttgggatggtggtagcacctactatgcagactctgtgaagggt

SEQ ID NO: 286 - DNA, 33 bp, Artificial Sequence
  TPP-17575_497A-M181-C17-1-hIgG1Lambda_HCDR3
gggggtatagggcgtcgtcctgggcttgagtac

SEQ ID NO: 287 - DNA, 324 bp, Artificial Sequence
  TPP-17575_497A-M181-C17-1-hIgG1Lambda_VL
cagtctgtgctgactcagccaccctcagcgtctgggacccccgggcagagggtcaccatctcctgctctggaagcagctccaacattggaaataattatgtttcctggtatcagcagctcccaggaacggcccccaaactcctcatctatggtaacagcaatcggccctcaggggtccctgaccgattctctggctccaagtctggcacctcagcctccctggccatcagtgggctccggtccgaggatgaggctgattattactgtcagacctggggcactggcattcgggtgttcggcggaggaaccaagctgacggtccta

SEQ ID NO: 288 - DNA, 39 bp, Artificial Sequence
  TPP-17575_497A-M181-C17-1-hIgG1Lambda_LCDR1
tctggaagcagctccaacattggaaataattatgtttcc

SEQ ID NO: 289 - DNA, 21 bp, Artificial Sequence
  TPP-17575_497A-M181-C17-1-hIgG1Lambda_LCDR2
ggtaacagcaatcggccctca

SEQ ID NO: 290 - DNA, 27 bp, Artificial Sequence
  TPP-17575_497A-M181-C17-1-hIgG1Lambda_LCDR3
cagacctggggcactggcattcgggtg

SEQ ID NO: 291 - protein, 449 aa, Artificial Sequence
  TPP-17575_497A-M181-C17-1-hIgG1Lambda_Heavy Chain
EVQLLESGGGLVQPGGSLRLSCAASGFTFRSYAMHWVRQAPGKGLEWVSLISWDGGSTYYADSVKGRFTISRDNSKNTLYLQMNSLRAEDTAVYYCARGGIGRRPGLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 292 - protein, 214 aa, Artificial Sequence
  TPP-17575_497A-M181-C17-1-hIgG1Lambda_Light Chain
QSVLTQPPSASGTPGQRVTISCSGSSSNIGNNYVSWYQQLPGTAPKLLIYGNSNRPSGVPDRFSGSKSGTSASLAISGLRSEDEADYYCQTWGTGIRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 293 - protein, 115 aa, Artificial Sequence
  TPP-17576_497A-M136-O21-1-hIgG1Lambda_VH
EVQLLESGGGLVQPGGSLRLSCAASGFTFSSYAMSWVRQAPGKGLEWVGRIRSKANSYATAYAASVKGRFTISRDNSKNTLYLQMNSLRAEDTAVYYCTRPLDSWGQGTLVTVSS

SEQ ID NO: 294 - protein, 5 aa, Artificial Sequence
  TPP-17576_497A-M136-O21-1-hIgG1Lambda_HCDR1
SYAMS

SEQ ID NO: 295 - protein, 19 aa, Artificial Sequence
  TPP-17576_497A-M136-O21-1-hIgG1Lambda_HCDR2
RIRSKANSYATAYAASVKG

SEQ ID NO: 296 - protein, 4 aa, Artificial Sequence
  TPP-17576_497A-M136-O21-1-hIgG1Lambda_HCDR3
PLDS

SEQ ID NO: 297 - protein, 110 aa, Artificial Sequence
  TPP-17576_497A-M136-O21-1-hIgG1Lambda_VL
QSVLTQPPSASGTPGQRVTISCSGSSSNIGNNAVNWYQQLPGTAPKLLIYRNNQRSSGVPDRFSGSKSGTSASLAISGLRSEDEADYYCQSYDNSLSASVFGGGTKLTVL

SEQ ID NO: 298 - protein, 13 aa, Artificial Sequence
  TPP-17576_497A-M136-O21-1-hIgG1Lambda_LCDR1
SGSSSNIGNNAVN

SEQ ID NO: 299 - protein, 7 aa, Artificial Sequence
  TPP-17576_497A-M136-O21-1-hIgG1Lambda_LCDR2
RNNQRSS

SEQ ID NO: 300 - protein, 11 aa, Artificial Sequence
  TPP-17576_497A-M136-O21-1-hIgG1Lambda_LCDR3
QSYDNSLSASV

SEQ ID NO: 301 - DNA, 345 bp, Artificial Sequence
  TPP-17576_497A-M136-O21-1-hIgG1Lambda_VH
gaggtgcagctgttggagtctgggggaggcttggtacagcctggggggtccctgagactctcctgtgcagcctctggattcacctttagcagctatgccatgagctgggtccgccaggctccagggaaggggctggagtgggttggccgtattagaagcaaagctaacagttacgcgacagcatatgctgcgtcggtgaaaggcaggttcaccatctccagagacaattccaagaacacgctgtatctgcaaatgaacagcctgagagccgaggacactgccgtgtattactgtacgaggcccttggactcctggggccaaggtaccctggtcaccgtgagttca

SEQ ID NO: 302 - DNA, 15 bp, Artificial Sequence
  TPP-17576_497A-M136-O21-1-hIgG1Lambda_HCDR1
agctatgccatgagc

SEQ ID NO: 303 - DNA, 57 bp, Artificial Sequence
  TPP-17576_497A-M136-O21-1-hIgG1Lambda_HCDR2
cgtattagaagcaaagctaacagttacgcgacagcatatgctgcgtcggtgaaaggc

SEQ ID NO: 304 - DNA, 12 bp, Artificial Sequence
  TPP-17576_497A-M136-O21-1-hIgG1Lambda_HCDR3
cccttggactcc

SEQ ID NO: 305 - DNA, 330 bp, Artificial Sequence
  TPP-17576_497A-M136-O21-1-hIgG1Lambda_VL
cagtctgtgctgactcagccaccctcagcgtctgggacccccgggcagagggtcaccatctcctgttctggaagcagctccaacatcggaaataatgctgtaaactggtatcagcagctcccaggaacggcccccaaactcctcatctatagaaataatcagcggtcctcaggggtccctgaccgattctctggctccaagtctggcacctcagcctccctggccatcagtgggctccggtccgaggatgaggctgattattactgccagtcctatgacaacagcctgagtgcttcggtgttcggcggaggaaccaagctgacggtccta

SEQ ID NO: 306 - DNA, 39 bp, Artificial Sequence
  TPP-17576_497A-M136-O21-1-hIgG1Lambda_LCDR1
tctggaagcagctccaacatcggaaataatgctgtaaac

SEQ ID NO: 307 - DNA, 21 bp, Artificial Sequence
  TPP-17576_497A-M136-O21-1-hIgG1Lambda_LCDR2
agaaataatcagcggtcctca

SEQ ID NO: 308 - DNA, 33 bp, Artificial Sequence
  TPP-17576_497A-M136-O21-1-hIgG1Lambda_LCDR3
cagtcctatgacaacagcctgagtgcttcggtg

SEQ ID NO: 309 - protein, 444 aa, Artificial Sequence
  TPP-17576_497A-M136-O21-1-hIgG1Lambda_Heavy Chain
EVQLLESGGGLVQPGGSLRLSCAASGFTFSSYAMSWVRQAPGKGLEWVGRIRSKANSYATAYAASVKGRFTISRDNSKNTLYLQMNSLRAEDTAVYYCTRPLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 310 - protein, 216 aa, Artificial Sequence
  TPP-17576_497A-M136-O21-1-hIgG1Lambda_Light Chain
QSVLTQPPSASGTPGQRVTISCSGSSSNIGNNAVNWYQQLPGTAPKLLIYRNNQRSSGVPDRFSGSKSGTSASLAISGLRSEDEADYYCQSYDNSLSASVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 311 - protein, 115 aa, Artificial Sequence
  TPP-17577_497A-M178-K09-1-hIgG1Lambda_VH
EVQLLESGGGLLQPGGSLRLSCAASGFTFSNAWMSWVRQAPGKGLEWVAVISYDGRNKYSADSVKGRFTISRDNSKNTLYLQMNSLRAEDTAVYYCARGLPYGYWGQGTLVTVSS

SEQ ID NO: 312 - protein, 5 aa, Artificial Sequence
  TPP-17577_497A-M178-K09-1-hIgG1Lambda_HCDR1
NAWMS

SEQ ID NO: 313 - protein, 17 aa, Artificial Sequence
  TPP-17577_497A-M178-K09-1-hIgG1Lambda_HCDR2
VISYDGRNKYSADSVKG

SEQ ID NO: 314 - protein, 6 aa, Artificial Sequence
  TPP-17577_497A-M178-K09-1-hIgG1Lambda_HCDR3
GLPYGY

SEQ ID NO: 315 - protein, 110 aa, Artificial Sequence
  TPP-17577_497A-M178-K09-1-hIgG1Lambda_VL
QSVLTQPPSASGTPGQRVTISCSGSSSNIGSNTVNWYQQLPGTAPKLLIYRNNQRPSGVPDRFSGSKSGTSASLAISGLRSEDEADYYCAAWDDSLKALVFGGGTKLTVL

SEQ ID NO: 316 - protein, 13 aa, Artificial Sequence
  TPP-17577_497A-M178-K09-1-hIgG1Lambda_LCDR1
SGSSSNIGSNTVN

SEQ ID NO: 317 - protein, 7 aa, Artificial Sequence
  TPP-17577_497A-M178-K09-1-hIgG1Lambda_LCDR2
RNNQRPS

SEQ ID NO: 318 - protein, 11 aa, Artificial Sequence
  TPP-17577_497A-M178-K09-1-hIgG1Lambda_LCDR3
AAWDDSLKALV

SEQ ID NO: 319 - DNA, 345 bp, Artificial Sequence
  TPP-17577_497A-M178-K09-1-hIgG1Lambda_VH
gaggtgcagctgttggagtctgggggaggcttgttacagcctggggggtccctgagactctcctgtgcagcctctggattcaccttcagtaacgcctggatgagctgggtccgccaggctccagggaaggggctggagtgggtggcagttatatcatatgatggaagaaataaatactctgcagactccgtgaagggccgattcaccatctccagagacaattccaagaacacgctgtatctgcaaatgaacagcctgagagccgaggacactgccgtgtattactgtgcgaggggcctcccttatggctactggggccaaggtaccctggtcaccgtgagttca

SEQ ID NO: 320 - DNA, 15 bp, Artificial Sequence
  TPP-17577_497A-M178-K09-1-hIgG1Lambda_HCDR1
aacgcctggatgagc

SEQ ID NO: 321 - DNA, 51 bp, Artificial Sequence
  TPP-17577_497A-M178-K09-1-hIgG1Lambda_HCDR2
gttatatcatatgatggaagaaataaatactctgcagactccgtgaagggc

SEQ ID NO: 322 - DNA, 18 bp, Artificial Sequence
  TPP-17577_497A-M178-K09-1-hIgG1Lambda_HCDR3
ggcctcccttatggctac

SEQ ID NO: 323 - DNA, 330 bp, Artificial Sequence
  TPP-17577_497A-M178-K09-1-hIgG1Lambda_VL
cagtctgtgctgactcagccaccctcagcgtctgggacccccgggcagagggtcaccatctcttgttctggaagcagctccaacatcggaagtaatactgtaaactggtatcagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgctgcatgggatgacagtctgaaggctctggtattcggcggaggaaccaagctgacggtccta

SEQ ID NO: 324 - DNA, 39 bp, Artificial Sequence
  TPP-17577_497A-M178-K09-1-hIgG1Lambda_LCDR1
tctggaagcagctccaacatcggaagtaatactgtaaac

SEQ ID NO: 325 - DNA, 21 bp, Artificial Sequence
  TPP-17577_497A-M178-K09-1-hIgG1Lambda_LCDR2
aggaataatcagcggccctca

SEQ ID NO: 326 - DNA, 33 bp, Artificial Sequence
  TPP-17577_497A-M178-K09-1-hIgG1Lambda_LCDR3
gctgcatgggatgacagtctgaaggctctggta

SEQ ID NO: 327 - protein, 444 aa, Artificial Sequence
  TPP-17577_497A-M178-K09-1-hIgG1Lambda_Heavy Chain
EVQLLESGGGLLQPGGSLRLSCAASGFTFSNAWMSWVRQAPGKGLEWVAVISYDGRNKYSADSVKGRFTISRDNSKNTLYLQMNSLRAEDTAVYYCARGLPYGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 328 - protein, 216 aa, Artificial Sequence
  TPP-17577_497A-M178-K09-1-hIgG1Lambda_Light Chain
QSVLTQPPSASGTPGQRVTISCSGSSSNIGSNTVNWYQQLPGTAPKLLIYRNNQRPSGVPDRFSGSKSGTSASLAISGLRSEDEADYYCAAWDDSLKALVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 329 - protein, 121 aa, Artificial Sequence
  TPP-17578_497A-M128-B10-1-hIgG1Lambda_VH
EVQLLESGGGLVQPGGSLRLSCAASGFTFSNAWMSWVRQAPGKGLEWVSGINWNGGSTGYADSVKGRFTISRDNSKNTLYLQMNSLRAEDTAVYYCVRTYSGHYGPYFDNWGQGTLVTVSS

SEQ ID NO: 330 - protein, 5 aa, Artificial Sequence
  TPP-17578_497A-M128-B10-1-hIgG1Lambda_HCDR1
NAWMS

SEQ ID NO: 331 - protein, 17 aa, Artificial Sequence
  TPP-17578_497A-M128-B10-1-hIgG1Lambda_HCDR2
GINWNGGSTGYADSVKG

SEQ ID NO: 332 - protein, 12 aa, Artificial Sequence
  TPP-17578_497A-M128-B10-1-hIgG1Lambda_HCDR3
TYSGHYGPYFDN

SEQ ID NO: 333 - protein, 110 aa, Artificial Sequence
  TPP-17578_497A-M128-B10-1-hIgG1Lambda_VL
QSVLTQPPSASGTPGQRVTISCSGSSSNIGSHTVNWYQQLPGTAPKLLIYRNNQRPSGVPDRFSGSKSGTSASLAISGLRSEDEADYYCAAWDDSLNGWVFGGGTKLTVL

SEQ ID NO: 334 - protein, 13 aa, Artificial Sequence
  TPP-17578_497A-M128-B10-1-hIgG1Lambda_LCDR1
SGSSSNIGSHTVN

SEQ ID NO: 335 - protein, 7 aa, Artificial Sequence
  TPP-17578_497A-M128-B10-1-hIgG1Lambda_LCDR2
RNNQRPS

SEQ ID NO: 336 - protein, 11 aa, Artificial Sequence
  TPP-17578_497A-M128-B10-1-hIgG1Lambda_LCDR3
AAWDDSLNGWV

SEQ ID NO: 337 - DNA, 363 bp, Artificial Sequence
  TPP-17578_497A-M128-B10-1-hIgG1Lambda_VH
gaggtgcagctgttggagtctgggggaggcttggtacagcctggggggtccctgagactctcctgtgcagcctctggattcaccttcagtaacgcctggatgagctgggtccgccaggctccagggaaggggctggagtgggtctctggtattaattggaatggtggtagcacaggttatgcagactctgtgaagggccgattcaccatctccagagacaattccaagaacacgctgtatctgcaaatgaacagcctgagagccgaggacactgccgtgtattactgtgttaggacgtatagtgggcactacggaccctactttgacaactggggccaaggtaccctggtcaccgtgagttca

SEQ ID NO: 338 - DNA, 15 bp, Artificial Sequence
  TPP-17578_497A-M128-B10-1-hIgG1Lambda_HCDR1
aacgcctggatgagc

SEQ ID NO: 339 - DNA, 51 bp, Artificial Sequence
  TPP-17578_497A-M128-B10-1-hIgG1Lambda_HCDR2
ggtattaattggaatggtggtagcacaggttatgcagactctgtgaagggc

SEQ ID NO: 340 - DNA, 36 bp, Artificial Sequence
  TPP-17578_497A-M128-B10-1-hIgG1Lambda_HCDR3
acgtatagtgggcactacggaccctactttgacaac

SEQ ID NO: 341 - DNA, 330 bp, Artificial Sequence
  TPP-17578_497A-M128-B10-1-hIgG1Lambda_VL
cagtctgtgctgactcagccaccctcagcgtctgggacccccgggcagagggtcaccatctcttgttctggaagcagctccaacatcggaagtcatactgtaaactggtatcagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgaatggttgggtgttcggcggaggaaccaagctgacggtccta

SEQ ID NO: 342 - DNA, 39 bp, Artificial Sequence
  TPP-17578_497A-M128-B10-1-hIgG1Lambda_LCDR1
tctggaagcagctccaacatcggaagtcatactgtaaac

SEQ ID NO: 343 - DNA, 21 bp, Artificial Sequence
  TPP-17578_497A-M128-B10-1-hIgG1Lambda_LCDR2
aggaataatcagcggccctca

SEQ ID NO: 344 - DNA, 33 bp, Artificial Sequence
  TPP-17578_497A-M128-B10-1-hIgG1Lambda_LCDR3
gcagcatgggatgacagcctgaatggttgggtg

SEQ ID NO: 345 - protein, 450 aa, Artificial Sequence
  TPP-17578_497A-M128-B10-1-hIgG1Lambda_Heavy Chain
EVQLLESGGGLVQPGGSLRLSCAASGFTFSNAWMSWVRQAPGKGLEWVSGINWNGGSTGYADSVKGRFTISRDNSKNTLYLQMNSLRAEDTAVYYCVRTYSGHYGPYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 346 - protein, 216 aa, Artificial Sequence
  TPP-17578_497A-M128-B10-1-hIgG1Lambda_Light Chain
QSVLTQPPSASGTPGQRVTISCSGSSSNIGSHTVNWYQQLPGTAPKLLIYRNNQRPSGVPDRFSGSKSGTSASLAISGLRSEDEADYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 347 - protein, 121 aa, Artificial Sequence
  TPP-17579_497A-M180-K04-1-hIgG1Lambda_VH
EVQLLESGGGLVQPGGSLRLSCAASGFTFVTYWMTWVRQAPGKGLEWVSGVSWNGSRTHYVDSVKRRFTISRDNSKNTLYLQMNSLRAEDTAVYYCARYSGYPDYYGMDVWGQGTLVTVSS

SEQ ID NO: 348 - protein, 5 aa, Artificial Sequence
  TPP-17579_497A-M180-K04-1-hIgG1Lambda_HCDR1
TYWMT

SEQ ID NO: 349 - protein, 17 aa, Artificial Sequence
  TPP-17579_497A-M180-K04-1-hIgG1Lambda_HCDR2
GVSWNGSRTHYVDSVKR

SEQ ID NO: 350 - protein, 12 aa, Artificial Sequence
  TPP-17579_497A-M180-K04-1-hIgG1Lambda_HCDR3
YSGYPDYYGMDV

SEQ ID NO: 351 - protein, 110 aa, Artificial Sequence
  TPP-17579_497A-M180-K04-1-hIgG1Lambda_VL
QSVLTQPPSASGTPGQRVTISCSGSWSNIGNDNVYWYQQLPGTAPKLLIYRNNQRPSGVPDRFSGSKSGTSASLAISGLRSEDEADYYCQSYDRSLSGSVFGGGTKLTVL

SEQ ID NO: 352 - protein, 13 aa, Artificial Sequence
  TPP-17579_497A-M180-K04-1-hIgG1Lambda_LCDR1
SGSWSNIGNDNVY

SEQ ID NO: 353 - protein, 7 aa, Artificial Sequence
  TPP-17579_497A-M180-K04-1-hIgG1Lambda_LCDR2
RNNQRPS

SEQ ID NO: 354 - protein, 11 aa, Artificial Sequence
  TPP-17579_497A-M180-K04-1-hIgG1Lambda_LCDR3
QSYDRSLSGSV

SEQ ID NO: 355 - DNA, 363 bp, Artificial Sequence
  TPP-17579_497A-M180-K04-1-hIgG1Lambda_VH
gaggtgcaactgttggagtctgggggaggcttggtacagcctggggggtccctgagactctcctgtgcagcctctggattcacctttgttacatattggatgacctgggtccgccaggctccagggaaggggctggagtgggtatcgggtgttagttggaatggcagtaggacgcactatgtggactccgtgaagcgccgattcaccatctccagagacaattccaagaacacgctgtatctgcaaatgaacagcctgagagccgaggacactgccgtgtattactgtgcgagatatagtggctaccctgactactacggtatggacgtctggggccaaggtaccctggtcaccgtgagttca

SEQ ID NO: 356 - DNA, 15 bp, Artificial Sequence
  TPP-17579_497A-M180-K04-1-hIgG1Lambda_HCDR1
acatattggatgacc

SEQ ID NO: 357 - DNA, 51 bp, Artificial Sequence
  TPP-17579_497A-M180-K04-1-hIgG1Lambda_HCDR2
ggtgttagttggaatggcagtaggacgcactatgtggactccgtgaagcgc

SEQ ID NO: 358 - DNA, 36 bp, Artificial Sequence
  TPP-17579_497A-M180-K04-1-hIgG1Lambda_HCDR3
tatagtggctaccctgactactacggtatggacgtc

SEQ ID NO: 359 - DNA, 330 bp, Artificial Sequence
  TPP-17579_497A-M180-K04-1-hIgG1Lambda_VL
cagtctgtgctgactcagccaccctcagcgtctgggacccccgggcagagggtcaccatctcttgttctggaagctggtccaacatcggaaatgataatgtatactggtatcagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgccagtcttatgacaggagcctgagtggttcggtgttcggcggaggaaccaagctgacggtccta

SEQ ID NO: 360 - DNA, 39 bp, Artificial Sequence
  TPP-17579_497A-M180-K04-1-hIgG1Lambda_LCDR1
tctggaagctggtccaacatcggaaatgataatgtatac

SEQ ID NO: 361 - DNA, 21 bp, Artificial Sequence
  TPP-17579_497A-M180-K04-1-hIgG1Lambda_LCDR2
aggaataatcagcggccctca

SEQ ID NO: 362 - DNA, 33 bp, Artificial Sequence
  TPP-17579_497A-M180-K04-1-hIgG1Lambda_LCDR3
cagtcttatgacaggagcctgagtggttcggtg

SEQ ID NO: 363 - protein, 450 aa, Artificial Sequence
  TPP-17579_497A-M180-K04-1-hIgG1Lambda_Heavy Chain
EVQLLESGGGLVQPGGSLRLSCAASGFTFVTYWMTWVRQAPGKGLEWVSGVSWNGSRTHYVDSVKRRFTISRDNSKNTLYLQMNSLRAEDTAVYYCARYSGYPDYYGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 364 - protein, 216 aa, Artificial Sequence
  TPP-17579_497A-M180-K04-1-hIgG1Lambda_Light Chain
QSVLTQPPSASGTPGQRVTISCSGSWSNIGNDNVYWYQQLPGTAPKLLIYRNNQRPSGVPDRFSGSKSGTSASLAISGLRSEDEADYYCQSYDRSLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 365 - protein, 120 aa, Artificial Sequence
  TPP-17580_497A-M193-A08-1-hIgG1Lambda_VH
EVQLLESGGGLVQPGGSLRLSCAASGFTFSSYGMHWVRQAPGKGLEWVSGVSWNGSRTRYADSVKGRFTISRDNSKNTLYLQMNSLRAEDTAVYYCTRGSYNSGWYAVSWGQGTLVTVSS

SEQ ID NO: 366 - protein, 5 aa, Artificial Sequence
  TPP-17580_497A-M193-A08-1-hIgG1Lambda_HCDR1
SYGMH

SEQ ID NO: 367 - protein, 17 aa, Artificial Sequence
  TPP-17580_497A-M193-A08-1-hIgG1Lambda_HCDR2
GVSWNGSRTRYADSVKG

SEQ ID NO: 368 - protein, 11 aa, Artificial Sequence
  TPP-17580_497A-M193-A08-1-hIgG1Lambda_HCDR3
GSYNSGWYAVS

SEQ ID NO: 369 - protein, 109 aa, Artificial Sequence
  TPP-17580_497A-M193-A08-1-hIgG1Lambda_VL
QSVLTQPPSASGTPGQRVTISCSGSSSNIGSYPVNWYQQLPGTAPKLLIYRNNQRPSGVPDRFSGSKSGTSASLAISGLRSEDEADYYCSSYSVTDNLIFGGGTKLTVL

SEQ ID NO: 370 - protein, 13 aa, Artificial Sequence
  TPP-17580_497A-M193-A08-1-hIgG1Lambda_LCDR1
SGSSSNIGSYPVN

SEQ ID NO: 371 - protein, 7 aa, Artificial Sequence
  TPP-17580_497A-M193-A08-1-hIgG1Lambda_LCDR2
RNNQRPS

SEQ ID NO: 372 - protein, 10 aa, Artificial Sequence
  TPP-17580_497A-M193-A08-1-hIgG1Lambda_LCDR3
SSYSVTDNLI

SEQ ID NO: 373 - DNA, 360 bp, Artificial Sequence
  TPP-17580_497A-M193-A08-1-hIgG1Lambda_VH
gaggtgcagctgttggagtctgggggaggcttggtacagcctggggggtccctgagactctcctgtgcagcctctggattcaccttcagtagctatggcatgcactgggtccgccaggctccaggcaaggggctggagtgggtatcgggtgttagttggaatggcagtaggacgcgctatgcggactctgtgaagggccgattcaccatctccagagacaattccaagaacacgctgtatctgcaaatgaacagcctgagagccgaggacactgccgtgtattactgtactagagggtcatataatagtggctggtacgcggtctcctggggccaaggtaccctggtcaccgtgagttca

SEQ ID NO: 374 - DNA, 15 bp, Artificial Sequence
  TPP-17580_497A-M193-A08-1-hIgG1Lambda_HCDR1
agctatggcatgcac

SEQ ID NO: 375 - DNA, 51 bp, Artificial Sequence
  TPP-17580_497A-M193-A08-1-hIgG1Lambda_HCDR2
ggtgttagttggaatggcagtaggacgcgctatgcggactctgtgaagggc

SEQ ID NO: 376 - DNA, 33 bp, Artificial Sequence
  TPP-17580_497A-M193-A08-1-hIgG1Lambda_HCDR3
gggtcatataatagtggctggtacgcggtctcc

SEQ ID NO: 377 - DNA, 327 bp, Artificial Sequence
  TPP-17580_497A-M193-A08-1-hIgG1Lambda_VL
cagtctgtgctgactcagccaccctcagcgtctgggacccctgggcagagggtcaccatctcttgttctggaagcagttccaacatcgggagttatcctgtaaactggtatcagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgcagctcatattctgtcaccgacaatttgatattcggcggaggaaccaagctgacggtccta

SEQ ID NO: 378 - DNA, 39 bp, Artificial Sequence
  TPP-17580_497A-M193-A08-1-hIgG1Lambda_LCDR1
tctggaagcagttccaacatcgggagttatcctgtaaac

SEQ ID NO: 379 - DNA, 21 bp, Artificial Sequence
  TPP-17580_497A-M193-A08-1-hIgG1Lambda_LCDR2
aggaataatcagcggccctca

SEQ ID NO: 380 - DNA, 30 bp, Artificial Sequence
  TPP-17580_497A-M193-A08-1-hIgG1Lambda_LCDR3
agctcatattctgtcaccgacaatttgata

SEQ ID NO: 381 - protein, 449 aa, Artificial Sequence
  TPP-17580_497A-M193-A08-1-hIgG1Lambda_Heavy Chain
EVQLLESGGGLVQPGGSLRLSCAASGFTFSSYGMHWVRQAPGKGLEWVSGVSWNGSRTRYADSVKGRFTISRDNSKNTLYLQMNSLRAEDTAVYYCTRGSYNSGWYAVSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 382 - protein, 215 aa, Artificial Sequence
  TPP-17580_497A-M193-A08-1-hIgG1Lambda_Light Chain
QSVLTQPPSASGTPGQRVTISCSGSSSNIGSYPVNWYQQLPGTAPKLLIYRNNQRPSGVPDRFSGSKSGTSASLAISGLRSEDEADYYCSSYSVTDNLIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 383 - protein, 122 aa, Artificial Sequence
  TPP-17581_497A-M177-L03-1-hIgG1Lambda_VH
EVQLLESGGGLVQPGGSLRLSCAASGFTFSNYRMTWVRQAPGKGLEWVSGINWNGGSTGYADSVKGRFTISRDNSKNTLYLQMNSLRAEDTAVYYCARGRFDTRGFYGFDYWGQGTLVTVSS

SEQ ID NO: 384 - protein, 5 aa, Artificial Sequence
  TPP-17581_497A-M177-L03-1-hIgG1Lambda_HCDR1
NYRMT

SEQ ID NO: 385 - protein, 17 aa, Artificial Sequence
  TPP-17581_497A-M177-L03-1-hIgG1Lambda_HCDR2
GINWNGGSTGYADSVKG

SEQ ID NO: 386 - protein, 13 aa, Artificial Sequence
  TPP-17581_497A-M177-L03-1-hIgG1Lambda_HCDR3
GRFDTRGFYGFDY

SEQ ID NO: 387 - protein, 111 aa, Artificial Sequence
  TPP-17581_497A-M177-L03-1-hIgG1Lambda_VL
QSVLTQPPSASGTPGQRVTISCTGSSSNIGAGYDVHWYQQLPGTAPKLLIYSHNQRPSGVPDRFSGSKSGTSASLAISGLRSEDEADYYCSAWDSSLSAWVFGGGTKLTVL

SEQ ID NO: 388 - protein, 14 aa, Artificial Sequence
  TPP-17581_497A-M177-L03-1-hIgG1Lambda_LCDR1
TGSSSNIGAGYDVH

SEQ ID NO: 389 - protein, 7 aa, Artificial Sequence
  TPP-17581_497A-M177-L03-1-hIgG1Lambda_LCDR2
SHNQRPS

SEQ ID NO: 390 - protein, 11 aa, Artificial Sequence
  TPP-17581_497A-M177-L03-1-hIgG1Lambda_LCDR3
SAWDSSLSAWV

SEQ ID NO: 391 - DNA, 366 bp, Artificial Sequence
  TPP-17581_497A-M177-L03-1-hIgG1Lambda_VH
gaggtgcagctgttggagtctgggggaggcttggtacagcctggggggtccctgagactctcctgtgcagcctctggattcaccttcagtaattataggatgacctgggtccgccaggctccagggaaggggctggagtgggtctctggtattaattggaatggtggtagcacaggttatgcagactctgtgaagggccgattcaccatctccagagacaattccaagaacacgctgtatctgcaaatgaacagcctgagagccgaggacactgccgtgtattactgtgccagagggcgctttgatactaggggtttttacggctttgactactggggccaaggtaccctggtcaccgtgagttca

SEQ ID NO: 392 - DNA, 15 bp, Artificial Sequence
  TPP-17581_497A-M177-L03-1-hIgG1Lambda_HCDR1
aattataggatgacc

SEQ ID NO: 393 - DNA, 51 bp, Artificial Sequence; identical to SEQ ID NO: 339
  TPP-17581_497A-M177-L03-1-hIgG1Lambda_HCDR2

SEQ ID NO: 394 - DNA, 39 bp, Artificial Sequence
  TPP-17581_497A-M177-L03-1-hIgG1Lambda_HCDR3
gggcgctttgatactaggggtttttacggctttgactac

SEQ ID NO: 395 - DNA, 333 bp, Artificial Sequence
  TPP-17581_497A-M177-L03-1-hIgG1Lambda_VL
cagtctgtgctgactcagccaccctcagcgtctgggacccccgggcagagggtcaccatctcctgcactgggagcagctccaacatcggggcaggttatgatgtacactggtatcagcagctcccaggaacggcccccaaactcctcatctatagtcataatcagcggccctcaggggtccctgaccgattctctggctccaagtctggcacctcagcctccctggccatcagtgggctccggtccgaggatgaggctgattattactgctcagcatgggacagcagcctcagtgcttgggtgttcggcggaggaaccaagctgacggtccta

SEQ ID NO: 396 - DNA, 42 bp, Artificial Sequence
  TPP-17581_497A-M177-L03-1-hIgG1Lambda_LCDR1
actgggagcagctccaacatcggggcaggttatgatgtacac

SEQ ID NO: 397 - DNA, 21 bp, Artificial Sequence
  TPP-17581_497A-M177-L03-1-hIgG1Lambda_LCDR2
agtcataatcagcggccctca

SEQ ID NO: 398 - DNA, 33 bp, Artificial Sequence
  TPP-17581_497A-M177-L03-1-hIgG1Lambda_LCDR3
tcagcatgggacagcagcctcagtgcttgggtg

SEQ ID NO: 399 - protein, 451 aa, Artificial Sequence
  TPP-17581_497A-M177-L03-1-hIgG1Lambda_Heavy Chain
EVQLLESGGGLVQPGGSLRLSCAASGFTFSNYRMTWVRQAPGKGLEWVSGINWNGGSTGYADSVKGRFTISRDNSKNTLYLQMNSLRAEDTAVYYCARGRFDTRGFYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 400 - protein, 217 aa, Artificial Sequence
  TPP-17581_497A-M177-L03-1-hIgG1Lambda_Light Chain
QSVLTQPPSASGTPGQRVTISCTGSSSNIGAGYDVHWYQQLPGTAPKLLIYSHNQRPSGVPDRFSGSKSGTSASLAISGLRSEDEADYYCSAWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 401 - protein, 122 aa, Artificial Sequence
  TPP-18205_004-F10_497A-M296-L12+497A-M326-O09-hIgG1Lambda_VH
EVQLLESGGGLVQPGGSLRLSCAASGFTFSSYAMSWVRQAPGKGLEWVSGIRWNSGSKGYAGSVKGRFTISRDNSKNTLYLQMNSLRAEDTAVYYCVRSGNYYVGYHGMDVWGQGTLVTVSS

SEQ ID NO: 402 - protein, 5 aa, Artificial Sequence
  TPP-18205_004-F10_497A-M296-L12+497A-M326-O09-hIgG1Lambda_HCDR1
SYAMS

SEQ ID NO: 403 - protein, 17 aa, Artificial Sequence
  TPP-18205_004-F10_497A-M296-L12+497A-M326-O09-hIgG1Lambda_HCDR2
GIRWNSGSKGYAGSVKG

SEQ ID NO: 404 - protein, 13 aa, Artificial Sequence
  TPP-18205_004-F10_497A-M296-L12+497A-M326-O09-hIgG1Lambda_HCDR3
SGNYYVGYHGMDV

SEQ ID NO: 405 - protein, 108 aa, Artificial Sequence
  TPP-18205_004-F10_497A-M296-L12+497A-M326-O09-hIgG1Lambda_VL
QSVLTQPPSASGTPGQRVTISCSGGNSNIGTYFVSWYQQLPGTAPKLLIYTNNQRPSGVPDRFSGSKSGTSASLAISGLRSEDEADYYCETWDSNTRVFGGGTKLTVL

SEQ ID NO: 406 - protein, 13 aa, Artificial Sequence
  TPP-18205_004-F10_497A-M296-L12+497A-M326-O09-hIgG1Lambda_LCDR1
SGGNSNIGTYFVS

SEQ ID NO: 407 - protein, 7 aa, Artificial Sequence
  TPP-18205_004-F10_497A-M296-L12+497A-M326-O09-hIgG1Lambda_LCDR2
TNNQRPS

SEQ ID NO: 408 - protein, 9 aa, Artificial Sequence
  TPP-18205_004-F10_497A-M296-L12+497A-M326-O09-hIgG1Lambda_LCDR3
ETWDSNTRV

SEQ ID NO: 409 - DNA, 366 bp, Artificial Sequence
  TPP-18205_004-F10_497A-M296-L12+497A-M326-O09-hIgG1Lambda_VH
gaagttcagctgctggaatctggcggcggactggttcaacctggcggatctctgagactgagctgtgccgccagcggcttcacctttagcagctacgccatgagctgggtccgacaggctcctggcaaaggccttgaatgggtgtccggcatcagatggaacagcggctctaagggctatgccggctctgtgaagggcagattcaccatcagccgggacaacagcaagaacaccctgtacctgcagatgaacagcctgagagccgaggacaccgccgtgtactactgtgtgcggagcggcaattactacgtgggctaccacggcatggatgtgtggggacagggaaccctggttaccgtttcttca

SEQ ID NO: 410 - DNA, 15 bp, Artificial Sequence
  TPP-18205_004-F10_497A-M296-L12+497A-M326-O09-hIgG1Lambda_HCDR1
agctacgccatgagc

SEQ ID NO: 411 - DNA, 51 bp, Artificial Sequence
  TPP-18205_004-F10_497A-M296-L12+497A-M326-O09-hIgG1Lambda_HCDR2
ggcatcagatggaacagcggctctaagggctatgccggctctgtgaagggc

SEQ ID NO: 412 - DNA, 39 bp, Artificial Sequence
  TPP-18205_004-F10_497A-M296-L12+497A-M326-O09-hIgG1Lambda_HCDR3
agcggcaattactacgtgggctaccacggcatggatgtg

SEQ ID NO: 413 - DNA, 324 bp, Artificial Sequence
  TPP-18205_004-F10_497A-M296-L12+497A-M326-O09-hIgG1Lambda_VL
cagtctgttctgacacagcctcctagcgcctctggcacacctggacagagagtgaccatcagctgtagcggcggcaacagcaacatcggcacctacttcgtgtcctggtatcagcagctgcctggcacagcccctaaactgctgatctacaccaacaaccagcggcctagcggcgtgcccgatagattttctggcagcaagagcggcacaagcgccagcctggctatctctggactgagatctgaggacgaggccgactactactgcgagacatgggacagcaacaccagagtgtttggcggaggcaccaagctgacagtgcta

SEQ ID NO: 414 - DNA, 39 bp, Artificial Sequence
  TPP-18205_004-F10_497A-M296-L12+497A-M326-O09-hIgG1Lambda_LCDR1
agcggcggcaacagcaacatcggcacctacttcgtgtcc

SEQ ID NO: 415 - DNA, 21 bp, Artificial Sequence
  TPP-18205_004-F10_497A-M296-L12+497A-M326-O09-hIgG1Lambda_LCDR2
accaacaaccagcggcctagc

SEQ ID NO: 416 - DNA, 27 bp, Artificial Sequence
  TPP-18205_004-F10_497A-M296-L12+497A-M326-O09-hIgG1Lambda_LCDR3
gagacatgggacagcaacaccagagtg

SEQ ID NO: 417 - protein, 451 aa, Artificial Sequence
  TPP-18205_004-F10_497A-M296-L12+497A-M326-O09-hIgG1Lambda_Heavy Chain
EVQLLESGGGLVQPGGSLRLSCAASGFTFSSYAMSWVRQAPGKGLEWVSGIRWNSGSKGYAGSVKGRFTISRDNSKNTLYLQMNSLRAEDTAVYYCVRSGNYYVGYHGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 418 - protein, 214 aa, Artificial Sequence
  TPP-18205_004-F10_497A-M296-L12+497A-M326-O09-hIgG1Lambda_Light Chain
QSVLTQPPSASGTPGQRVTISCSGGNSNIGTYFVSWYQQLPGTAPKLLIYTNNQRPSGVPDRFSGSKSGTSASLAISGLRSEDEADYYCETWDSNTRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 419 - protein, 122 aa, Artificial Sequence
  TPP-18206_002-F01_497A-M281-P02+497A-M317-O07-hIgG1Lambda_VH
EVQLLESGGGLVQPGGSLRLSCAASGFTFSHYGMHWVRQAPGKGLEWVSGINWNGGSTGYADSVKGRFTISRDNSKNTLYLQMNSLRAEDTAVYYCARGHHSGYDGRFFDYWGQGTLVTVSS

SEQ ID NO: 420 - protein, 5 aa, Artificial Sequence
  TPP-18206_002-F01_497A-M281-P02+497A-M317-O07-hIgG1Lambda_HCDR1
HYGMH

SEQ ID NO: 421 - protein, 17 aa, Artificial Sequence
  TPP-18206_002-F01_497A-M281-P02+497A-M317-O07-hIgG1Lambda_HCDR2
GINWNGGSTGYADSVKG

SEQ ID NO: 422 - protein, 13 aa, Artificial Sequence
  TPP-18206_002-F01_497A-M281-P02+497A-M317-O07-hIgG1Lambda_HCDR3
GHHSGYDGRFFDY

SEQ ID NO: 423 - protein, 111 aa, Artificial Sequence
  TPP-18206_002-F01_497A-M281-P02+497A-M317-O07-hIgG1Lambda_VL
QSVLTQPPSASGTPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVL

SEQ ID NO: 424 - protein, 14 aa, Artificial Sequence
  TPP-18206_002-F01_497A-M281-P02+497A-M317-O07-hIgG1Lambda_LCDR1
TGSSSNIGAGYNVH

SEQ ID NO: 425 - protein, 7 aa, Artificial Sequence
  TPP-18206_002-F01_497A-M281-P02+497A-M317-O07-hIgG1Lambda_LCDR2
TNNRRPS

SEQ ID NO: 426 - protein, 11 aa, Artificial Sequence
  TPP-18206_002-F01_497A-M281-P02+497A-M317-O07-hIgG1Lambda_LCDR3
AAWDASLSGWV

SEQ ID NO: 427 - DNA, 366 bp, Artificial Sequence
  TPP-18206_002-F01_497A-M281-P02+497A-M317-O07-hIgG1Lambda_VH
gaagttcagctgctggaatctggcggcggactggttcaacctggcggatctctgagactgagctgtgccgccagcggcttcacctttagccactatggcatgcactgggtccgacaggcccctggcaaaggacttgaatgggtgtccggcatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttca

SEQ ID NO: 428 - DNA, 15 bp, Artificial Sequence
  TPP-18206_002-F01_497A-M281-P02+497A-M317-O07-hIgG1Lambda_HCDR1
cactatggcatgcac

SEQ ID NO: 429 - DNA, 51 bp, Artificial Sequence
  TPP-18206_002-F01_497A-M281-P02+497A-M317-O07-hIgG1Lambda_HCDR2
ggcatcaactggaatggcggctctacaggctacgccgactctgtgaagggc

SEQ ID NO: 430 - DNA, 39 bp, Artificial Sequence
  TPP-18206_002-F01_497A-M281-P02+497A-M317-O07-hIgG1Lambda_HCDR3
ggccaccacagcggctacgacggcagattctttgactat

SEQ ID NO: 431 - DNA, 333 bp, Artificial Sequence
  TPP-18206_002-F01_497A-M281-P02+497A-M317-O07-hIgG1Lambda_VL
cagtctgttctgacacagcctcctagcgcctctggcacacctggacagagagtgaccatcagctgtaccggcagcagctccaatatcggagccggctacaacgtgcactggtatcagcagctgcctggcacagcccctaaactgctgatctacaccaacaacagacggcccagcggcgtgcccgatagattttctggcagcaagagcggcacaagcgccagcctggctatctctggactgagatctgaggacgaggccgactactattgcgccgcctgggatgcttctctgagcggatgggttttcggcggaggcaccaaactgacagtgcta

SEQ ID NO: 432 - DNA, 42 bp, Artificial Sequence
  TPP-18206_002-F01_497A-M281-P02+497A-M317-O07-hIgG1Lambda_LCDR1
accggcagcagctccaatatcggagccggctacaacgtgcac

SEQ ID NO: 433 - DNA, 21 bp, Artificial Sequence
  TPP-18206_002-F01_497A-M281-P02+497A-M317-O07-hIgG1Lambda_LCDR2
accaacaacagacggcccagc

SEQ ID NO: 434 - DNA, 33 bp, Artificial Sequence
  TPP-18206_002-F01_497A-M281-P02+497A-M317-O07-hIgG1Lambda_LCDR3
gccgcctgggatgcttctctgagcggatgggtt

SEQ ID NO: 435 - protein, 451 aa, Artificial Sequence
  TPP-18206_002-F01_497A-M281-P02+497A-M317-O07-hIgG1Lambda_Heavy Chain
EVQLLESGGGLVQPGGSLRLSCAASGFTFSHYGMHWVRQAPGKGLEWVSGINWNGGSTGYADSVKGRFTISRDNSKNTLYLQMNSLRAEDTAVYYCARGHHSGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 436 - protein, 217 aa, Artificial Sequence
  TPP-18206_002-F01_497A-M281-P02+497A-M317-O07-hIgG1Lambda_Light Chain
QSVLTQPPSASGTPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 437 - protein, 121 aa, Artificial Sequence
  TPP-18207_001-B08_497A-M301-B18+497A-M316-D16-hIgG1Lambda_VH
EVQLLESGGGLVQPGGSLRLSCAASGFTFSNAWMSWVRQAPGKGLEWVSGINWNGGSTGYADSVKGRFTISRDNSKNTLYLQMNSLRAEDTAVYYCARTYTGNYGPYFDYWGQGTLVTVSS

SEQ ID NO: 438 - protein, 5 aa, Artificial Sequence
  TPP-18207_001-B08_497A-M301-B18+497A-M316-D16-hIgG1Lambda_HCDR1
NAWMS

SEQ ID NO: 439 - protein, 17 aa, Artificial Sequence
  TPP-18207_001-B08_497A-M301-B18+497A-M316-D16-hIgG1Lambda_HCDR2
GINWNGGSTGYADSVKG

SEQ ID NO: 440 - protein, 12 aa, Artificial Sequence
  TPP-18207_001-B08_497A-M301-B18+497A-M316-D16-hIgG1Lambda_HCDR3
TYTGNYGPYFDY

SEQ ID NO: 441 - protein, 111 aa, Artificial Sequence
  TPP-18207_001-B08_497A-M301-B18+497A-M316-D16-hIgG1Lambda_VL
QSVLTQPPSASGTPGQRVTISCTGSSSNIGAGYDVHWYQQLPGTAPKLLIYKNNQRPSGVPDRFSGSKSGTSASLAISGLRSEDEADYYCAAWDDSLRGWVFGGGTKLTVL

SEQ ID NO: 442 - protein, 14 aa, Artificial Sequence
  TPP-18207_001-B08_497A-M301-B18+497A-M316-D16-hIgG1Lambda_LCDR1
TGSSSNIGAGYDVH

SEQ ID NO: 443 - protein, 7 aa, Artificial Sequence
  TPP-18207_001-B08_497A-M301-B18+497A-M316-D16-hIgG1Lambda_LCDR2
KNNQRPS

SEQ ID NO: 444 - protein, 11 aa, Artificial Sequence
  TPP-18207_001-B08_497A-M301-B18+497A-M316-D16-hIgG1Lambda_LCDR3
AAWDDSLRGWV

SEQ ID NO: 445 - DNA, 363 bp, Artificial Sequence
  TPP-18207_001-B08_497A-M301-B18+497A-M316-D16-hIgG1Lambda_VH
gaagttcagctgctggaatctggcggcggactggttcaacctggcggatctctgagactgagctgtgccgccagcggcttcacctttagcaatgcctggatgagctgggtccgacaggcccctggaaaaggccttgaatgggtgtccggcatcaactggaatggcggctctacaggctacgccgactctgtgaagggcagattcaccatcagccgggacaacagcaagaacaccctgtacctgcagatgaactccctgagagccgaggacaccgccgtgtactactgtgccagaacctacaccggcaactacggcccctacttcgattattggggccagggcacactggtcaccgtttcttca

SEQ ID NO: 446 - DNA, 15 bp, Artificial Sequence
  TPP-18207_001-B08_497A-M301-B18+497A-M316-D16-hIgG1Lambda_HCDR1
aatgcctggatgagc

SEQ ID NO: 447 - DNA, 51 bp, Artificial Sequence; identical to SEQ ID NO: 429
  TPP-18207_001-B08_497A-M301-B18+497A-M316-D16-hIgG1Lambda_HCDR2

SEQ ID NO: 448 - DNA, 36 bp, Artificial Sequence
  TPP-18207_001-B08_497A-M301-B18+497A-M316-D16-hIgG1Lambda_HCDR3
acctacaccggcaactacggcccctacttcgattat

SEQ ID NO: 449 - DNA, 333 bp, Artificial Sequence
  TPP-18207_001-B08_497A-M301-B18+497A-M316-D16-hIgG1Lambda_VL
cagtctgttctgacacagcctcctagcgcctctggcacacctggacagagagtgaccatcagctgtaccggcagcagctccaatatcggagccggctatgacgtgcactggtatcagcagctgcctggcacagcccctaaactgctgatctacaagaacaaccagcggcctagcggcgtgcccgatagattttctggcagcaagagcggcacaagcgccagcctggctatctctggactgagatctgaggacgaggccgactactattgcgccgcctgggatgattctctgagaggctgggttttcggcggaggcaccaaactgacagtgcta

SEQ ID NO: 450 - DNA, 42 bp, Artificial Sequence
  TPP-18207_001-B08_497A-M301-B18+497A-M316-D16-hIgG1Lambda_LCDR1
accggcagcagctccaatatcggagccggctatgacgtgcac

SEQ ID NO: 451 - DNA, 21 bp, Artificial Sequence
  TPP-18207_001-B08_497A-M301-B18+497A-M316-D16-hIgG1Lambda_LCDR2
aagaacaaccagcggcctagc

SEQ ID NO: 452 - DNA, 33 bp, Artificial Sequence
  TPP-18207_001-B08_497A-M301-B18+497A-M316-D16-hIgG1Lambda_LCDR3
gccgcctgggatgattctctgagaggctgggtt

SEQ ID NO: 453 - protein, 450 aa, Artificial Sequence
  TPP-18207_001-B08_497A-M301-B18+497A-M316-D16-hIgG1Lambda_Heavy Chain
EVQLLESGGGLVQPGGSLRLSCAASGFTFSNAWMSWVRQAPGKGLEWVSGINWNGGSTGYADSVKGRFTISRDNSKNTLYLQMNSLRAEDTAVYYCARTYTGNYGPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 454 - protein, 217 aa, Artificial Sequence
  TPP-18207_001-B08_497A-M301-B18+497A-M316-D16-hIgG1Lambda_Light Chain
QSVLTQPPSASGTPGQRVTISCTGSSSNIGAGYDVHWYQQLPGTAPKLLIYKNNQRPSGVPDRFSGSKSGTSASLAISGLRSEDEADYYCAAWDDSLRGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 455 - protein, 121 aa, Artificial Sequence
  TPP-19546_17578-gl33-hIgG1Lambda_VH
EVQLLESGGGLVQPGGSLRLSCAASGFTFSSAWMSWVRQAPGKGLEWVSGISWSGGSTGYADSVKGRFTISRDNSKNTLYLQMNSLRAEDTAVYYCARTYSGHYGPYFDYWGQGTLVTVSS

SEQ ID NO: 456 - protein, 5 aa, Artificial Sequence
  TPP-19546_17578-gl33-hIgG1Lambda_HCDR1
SAWMS

SEQ ID NO: 457 - protein, 17 aa, Artificial Sequence
  TPP-19546_17578-gl33-hIgG1Lambda_HCDR2
GISWSGGSTGYADSVKG

SEQ ID NO: 458 - protein, 12 aa, Artificial Sequence
  TPP-19546_17578-gl33-hIgG1Lambda_HCDR3
TYSGHYGPYFDY

SEQ ID NO: 459 - protein, 110 aa, Artificial Sequence; identical to SEQ ID NO: 333
  TPP-19546_17578-gl33-hIgG1Lambda_VL

SEQ ID NO: 460 - protein, 13 aa, Artificial Sequence
  TPP-19546_17578-gl33-hIgG1Lambda_LCDR1
SGSSSNIGSHTVN

SEQ ID NO: 461 - protein, 7 aa, Artificial Sequence
  TPP-19546_17578-gl33-hIgG1Lambda_LCDR2
RNNQRPS

SEQ ID NO: 462 - protein, 11 aa, Artificial Sequence
  TPP-19546_17578-gl33-hIgG1Lambda_LCDR3
AAWDDSLNGWV

SEQ ID NO: 463 - DNA, 363 bp, Artificial Sequence
  TPP-19546_17578-gl33-hIgG1Lambda_VH
gaagttcagctgctggaatctggcggcggactggttcaacctggcggatctctgagactgagctgtgccgccagcggcttcacattttctagcgcctggatgagctgggtccgacaggctcctggaaaaggcctggaatgggtgtccggcatctcttggagcggcggctctacaggctatgccgattctgtgaagggcagattcaccatcagccgggacaacagcaagaacaccctgtacctgcagatgaactccctgagagccgaggacaccgccgtgtactactgtgccagaacatacagcggccactacggcccctacttcgattattggggccagggcacactggtcaccgtttcttca

SEQ ID NO: 464 - DNA, 15 bp, Artificial Sequence
  TPP-19546_17578-gl33-hIgG1Lambda_HCDR1
agcgcctggatgagc

SEQ ID NO: 465 - DNA, 51 bp, Artificial Sequence
  TPP-19546_17578-gl33-hIgG1Lambda_HCDR2
ggcatctcttggagcggcggctctacaggctatgccgattctgtgaagggc

SEQ ID NO: 466 - DNA, 36 bp, Artificial Sequence
  TPP-19546_17578-gl33-hIgG1Lambda_HCDR3
acatacagcggccactacggcccctacttcgattat

SEQ ID NO: 467 - DNA, 330 bp, Artificial Sequence; identical to SEQ ID NO: 341
  TPP-19546_17578-gl33-hIgG1Lambda_VL

SEQ ID NO: 468 - DNA, 39 bp, Artificial Sequence; identical to SEQ ID NO: 342
  TPP-19546_17578-gl33-hIgG1Lambda_LCDR1

SEQ ID NO: 469 - DNA, 21 bp, Artificial Sequence
  TPP-19546_17578-gl33-hIgG1Lambda_LCDR2
aggaataatcagcggccctca

SEQ ID NO: 470 - DNA, 33 bp, Artificial Sequence; identical to SEQ ID NO: 344
  TPP-19546_17578-gl33-hIgG1Lambda_LCDR3

SEQ ID NO: 471 - protein, 450 aa, Artificial Sequence
  TPP-19546_17578-gl33-hIgG1Lambda_Heavy Chain
EVQLLESGGGLVQPGGSLRLSCAASGFTFSSAWMSWVRQAPGKGLEWVSGISWSGGSTGYADSVKGRFTISRDNSKNTLYLQMNSLRAEDTAVYYCARTYSGHYGPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 472 - protein, 216 aa, Artificial Sequence; identical to SEQ ID NO: 346
  TPP-19546_17578-gl33-hIgG1Lambda_Light Chain

SEQ ID NO: 473 - protein, 122 aa, Artificial Sequence
  TPP-20950_18206-gl-42-hIgG1wt-Lambda_VH
EVQLLESGGGLVQPGGSLRLSCAASGFTFSSYGMHWVRQAPGKGLEWVSAIKWGGGSHGYADSVKGRFTISRDNSKNTLYLQMNSLRAEDTAVYYCARGHHSGKDGRFFDYWGQGTLVTVSS

SEQ ID NO: 474 - protein, 5 aa, Artificial Sequence
  TPP-20950_18206-gl-42-hIgG1wt-Lambda_HCDR1
SYGMH

SEQ ID NO: 475 - protein, 17 aa, Artificial Sequence
  TPP-20950_18206-gl-42-hIgG1wt-Lambda_HCDR2
AIKWGGGSHGYADSVKG

SEQ ID NO: 476 - protein, 13 aa, Artificial Sequence
  TPP-20950_18206-gl-42-hIgG1wt-Lambda_HCDR3
GHHSGKDGRFFDY

SEQ ID NO: 477 - protein, 111 aa, Artificial Sequence
  TPP-20950_18206-gl-42-hIgG1wt-Lambda_VL
QSVLTQPPSVSGAPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVL

SEQ ID NO: 478 - protein, 14 aa, Artificial Sequence
  TPP-20950_18206-gl-42-hIgG1wt-Lambda_LCDR1
TGSSSNIGAGYNVH

SEQ ID NO: 479 - protein, 7 aa, Artificial Sequence
  TPP-20950_18206-gl-42-hIgG1wt-Lambda_LCDR2
TNNRRPS

SEQ ID NO: 480 - protein, 11 aa, Artificial Sequence
  TPP-20950_18206-gl-42-hIgG1wt-Lambda_LCDR3
AAWDASLSGWV

SEQ ID NO: 481 - DNA, 366 bp, Artificial Sequence
  TPP-20950_18206-gl-42-hIgG1wt-Lambda_VH
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccattaagtggggcggaggctctcacggctatgccgattctgtgaagggcagattcaccatcagccgggacaacagcaagaacaccctgtacctgcagatgaacagcctgagagccgaggacaccgccgtgtactattgtgccagaggccaccactctggcaaggacggcagattcttcgactattggggccagggcaccctggtcacagtttcttca

SEQ ID NO: 482 - DNA, 15 bp, Artificial Sequence
  TPP-20950_18206-gl-42-hIgG1wt-Lambda_HCDR1
agctatggcatgcac

SEQ ID NO: 483 - DNA, 51 bp, Artificial Sequence
  TPP-20950_18206-gl-42-hIgG1wt-Lambda_HCDR2
gccattaagtggggcggaggctctcacggctatgccgattctgtgaagggc

SEQ ID NO: 484 - DNA, 39 bp, Artificial Sequence
  TPP-20950_18206-gl-42-hIgG1wt-Lambda_HCDR3
ggccaccactctggcaaggacggcagattcttcgactat

SEQ ID NO: 485 - DNA, 333 bp, Artificial Sequence
  TPP-20950_18206-gl-42-hIgG1wt-Lambda_VL
cagtctgttctgacacagcctccatctgtgtctggcgcccctggacagagagtgaccatcagctgtacaggcagcagctccaatatcggagccggctacaacgtgcactggtatcagcagctgcctggcacagcccctaaactgctgatctacaccaacaacagacggcccagcggcgtgcccgatagattttctggcagcaagagcggcacaagcgccagcctggctatctctggactgagatctgaggacgaggccgactactattgcgccgcctgggatgcttctctgagcggatgggttttcggcggaggcaccaaactgacagtgcta

SEQ ID NO: 486 - DNA, 42 bp, Artificial Sequence
  TPP-20950_18206-gl-42-hIgG1wt-Lambda_LCDR1
acaggcagcagctccaatatcggagccggctacaacgtgcac

SEQ ID NO: 487 - DNA, 21 bp, Artificial Sequence
  TPP-20950_18206-gl-42-hIgG1wt-Lambda_LCDR2
accaacaacagacggcccagc

SEQ ID NO: 488 - DNA, 33 bp, Artificial Sequence; identical to SEQ ID NO: 434
  TPP-20950_18206-gl-42-hIgG1wt-Lambda_LCDR3

SEQ ID NO: 489 - protein, 452 aa, Artificial Sequence
  TPP-20950_18206-gl-42-hIgG1wt-Lambda_Heavy Chain
EVQLLESGGGLVQPGGSLRLSCAASGFTFSSYGMHWVRQAPGKGLEWVSAIKWGGGSHGYADSVKGRFTISRDNSKNTLYLQMNSLRAEDTAVYYCARGHHSGKDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - protein, 217 aa, Artificial Sequence
  TPP-20950_18206-gl-42-hIgG1wt-Lambda_Light Chain
QSVLTQPPSVSGAPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 491 - protein, 122 aa, Artificial Sequence
  TPP-20955_18206-gl-47-hIgG1wt-Lambda_VH
EVQLLESGGGLVQPGGSLRLSCAASGFTFSSYGMHWVRQAPGKGLEWVSAIKWGGGSHGYADSVKGRFTISRDNSKNTLYLQMNSLRAEDTAVYYCARGHHKGYDGRFFDYWGQGTLVTVSS

SEQ ID NO: 492 - protein, 5 aa, Artificial Sequence
  TPP-20955_18206-gl-47-hIgG1wt-Lambda_HCDR1
SYGMH

SEQ ID NO: 493 - protein, 17 aa, Artificial Sequence
  TPP-20955_18206-gl-47-hIgG1wt-Lambda_HCDR2
AIKWGGGSHGYADSVKG

SEQ ID NO: 494 - protein, 13 aa, Artificial Sequence
  TPP-20955_18206-gl-47-hIgG1wt-Lambda_HCDR3
GHHKGYDGRFFDY

SEQ ID NO: 495 - protein, 111 aa, Artificial Sequence; identical to SEQ ID NO: 477
  TPP-20955_18206-gl-47-hIgG1wt-Lambda_VL

SEQ ID NO: 496 - protein, 14 aa, Artificial Sequence
  TPP-20955_18206-gl-47-hIgG1wt-Lambda_LCDR1
TGSSSNIGAGYNVH

SEQ ID NO: 497 - protein, 7 aa, Artificial Sequence
  TPP-20955_18206-gl-47-hIgG1wt-Lambda_LCDR2
TNNRRPS

SEQ ID NO: 498 - protein, 11 aa, Artificial Sequence
  TPP-20955_18206-gl-47-hIgG1wt-Lambda_LCDR3
AAWDASLSGWV

SEQ ID NO: 499 - DNA, 366 bp, Artificial Sequence
  TPP-20955_18206-gl-47-hIgG1wt-Lambda_VH
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccattaagtggggcggaggctctcacggctatgccgattctgtgaagggcagattcaccatcagccgggacaacagcaagaacaccctgtacctgcagatgaacagcctgagagccgaggacaccgccgtgtactattgtgccagaggccaccacaagggctacgacggcagattcttcgactattggggccagggcaccctggtcacagtttcttca

SEQ ID NO: 500 - DNA, 15 bp, Artificial Sequence
  TPP-20955_18206-gl-47-hIgG1wt-Lambda_HCDR1
agctatggcatgcac

SEQ ID NO: 501 - DNA, 51 bp, Artificial Sequence; identical to SEQ ID NO: 483
  TPP-20955_18206-gl-47-hIgG1wt-Lambda_HCDR2

SEQ ID NO: 502 - DNA, 39 bp, Artificial Sequence
  TPP-20955_18206-gl-47-hIgG1wt-Lambda_HCDR3
ggccaccacaagggctacgacggcagattcttcgactat

SEQ ID NO: 503 - DNA, 333 bp, Artificial Sequence; identical to SEQ ID NO: 485
  TPP-20955_18206-gl-47-hIgG1wt-Lambda_VL

SEQ ID NO: 504 - DNA, 42 bp, Artificial Sequence; identical to SEQ ID NO: 486
  TPP-20955_18206-gl-47-hIgG1wt-Lambda_LCDR1

SEQ ID NO: 505 - DNA, 21 bp, Artificial Sequence
  TPP-20955_18206-gl-47-hIgG1wt-Lambda_LCDR2
accaacaacagacggcccagc

SEQ ID NO: 506 - DNA, 33 bp, Artificial Sequence; identical to SEQ ID NO: 434
  TPP-20955_18206-gl-47-hIgG1wt-Lambda_LCDR3

SEQ ID NO: 507 - protein, 452 aa, Artificial Sequence
  TPP-20955_18206-gl-47-hIgG1wt-Lambda_Heavy Chain
EVQLLESGGGLVQPGGSLRLSCAASGFTFSSYGMHWVRQAPGKGLEWVSAIKWGGGSHGYADSVKGRFTISRDNSKNTLYLQMNSLRAEDTAVYYCARGHHKGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 508 - protein, 217 aa, Artificial Sequence; identical to SEQ ID NO: 490
  TPP-20955_18206-gl-47-hIgG1wt-Lambda_Light Chain

SEQ ID NO: 509 - protein, 122 aa, Artificial Sequence
  TPP-20965_18206-gl-58-hIgG1wt-Lambda_VH
EVQLLESGGGLVQPGGSLRLSCAASGFTFSSYGMHWVRQAPGKGLEWVSAIKWGGGSTGYADSVKGRFTISRDNSKNTLYLQMNSLRAEDTAVYYCARGHHSGKDGRFFDYWGQGTLVTVSS

SEQ ID NO: 510 - protein, 5 aa, Artificial Sequence
  TPP-20965_18206-gl-58-hIgG1wt-Lambda_HCDR1
SYGMH

SEQ ID NO: 511 - protein, 17 aa, Artificial Sequence
  TPP-20965_18206-gl-58-hIgG1wt-Lambda_HCDR2
AIKWGGGSTGYADSVKG

SEQ ID NO: 512 - protein, 13 aa, Artificial Sequence
  TPP-20965_18206-gl-58-hIgG1wt-Lambda_HCDR3
GHHSGKDGRFFDY

SEQ ID NO: 513 - protein, 111 aa, Artificial Sequence; identical to SEQ ID NO: 477
  TPP-20965_18206-gl-58-hIgG1wt-Lambda_VL

SEQ ID NO: 514 - protein, 14 aa, Artificial Sequence
  TPP-20965_18206-gl-58-hIgG1wt-Lambda_LCDR1
TGSSSNIGAGYNVH

SEQ ID NO: 515 - protein, 7 aa, Artificial Sequence
  TPP-20965_18206-gl-58-hIgG1wt-Lambda_LCDR2
TNNRRPS

SEQ ID NO: 516 - protein, 11 aa, Artificial Sequence
  TPP-20965_18206-gl-58-hIgG1wt-Lambda_LCDR3
AAWDASLSGWV

SEQ ID NO: 517 - DNA, 366 bp, Artificial Sequence
  TPP-20965_18206-gl-58-hIgG1wt-Lambda_VH
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccattaagtggggcggaggctctacaggctacgccgattctgtgaagggcagattcaccatcagccgggacaacagcaagaacaccctgtacctgcagatgaacagcctgagagccgaggacaccgccgtgtactattgtgccagaggccaccactctggcaaggacggcagattcttcgactattggggccagggcaccctggtcacagtttcttca

SEQ ID NO: 518 - DNA, 15 bp, Artificial Sequence
  TPP-20965_18206-gl-58-hIgG1wt-Lambda_HCDR1
agctatggcatgcac

SEQ ID NO: 519 - DNA, 51 bp, Artificial Sequence
  TPP-20965_18206-gl-58-hIgG1wt-Lambda_HCDR2
gccattaagtggggcggaggctctacaggctacgccgattctgtgaagggc

SEQ ID NO: 520 - DNA, 39 bp, Artificial Sequence; identical to SEQ ID NO: 484
  TPP-20965_18206-gl-58-hIgG1wt-Lambda_HCDR3

SEQ ID NO: 521 - DNA, 333 bp, Artificial Sequence; identical to SEQ ID NO: 485
  TPP-20965_18206-gl-58-hIgG1wt-Lambda_VL

SEQ ID NO: 522 - DNA, 42 bp, Artificial Sequence; identical to SEQ ID NO: 486
  TPP-20965_18206-gl-58-hIgG1wt-Lambda_LCDR1

SEQ ID NO: 523 - DNA, 21 bp, Artificial Sequence
  TPP-20965_18206-gl-58-hIgG1wt-Lambda_LCDR2
accaacaacagacggcccagc

SEQ ID NO: 524 - DNA, 33 bp, Artificial Sequence; identical to SEQ ID NO: 434
  TPP-20965_18206-gl-58-hIgG1wt-Lambda_LCDR3

SEQ ID NO: 525 - protein, 452 aa, Artificial Sequence
  TPP-20965_18206-gl-58-hIgG1wt-Lambda_Heavy Chain
EVQLLESGGGLVQPGGSLRLSCAASGFTFSSYGMHWVRQAPGKGLEWVSAIKWGGGSTGYADSVKGRFTISRDNSKNTLYLQMNSLRAEDTAVYYCARGHHSGKDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 217 aa, Artificial Sequence; identical to SEQ ID NO: 490
  TPP-20965_18206-gl-58-hIgG1wt-Lambda_Light Chain

SEQ ID NO: 527 - protein, 121 aa, Artificial Sequence
  TPP-21045_17578-gl79-hIgG1-wt-Lambda_VH
EVQLLESGGGLVQPGGSLRLSCAASGFTFSSAWMSWVRQAPGKGLEWVSGISWSGGSTGYALSVKGRFTISRDNSKNTLYLQMNSLRAEDTAVYYCARTYSGHYGPFFDYWGQGTLVTVSS

SEQ ID NO: 528 - protein, 5 aa, Artificial Sequence
  TPP-21045_17578-gl79-hIgG1-wt-Lambda_HCDR1
SAWMS

SEQ ID NO: 529 - protein, 17 aa, Artificial Sequence
  TPP-21045_17578-gl79-hIgG1-wt-Lambda_HCDR2
GISWSGGSTGYALSVKG

SEQ ID NO: 530 - protein, 12 aa, Artificial Sequence
  TPP-21045_17578-gl79-hIgG1-wt-Lambda_HCDR3
TYSGHYGPFFDY

SEQ ID NO: 531 - protein, 110 aa, Artificial Sequence; identical to SEQ ID NO: 333
  TPP-21045_17578-gl79-hIgG1-wt-Lambda_VL

SEQ ID NO: 532 - protein, 13 aa, Artificial Sequence
  TPP-21045_17578-gl79-hIgG1-wt-Lambda_LCDR1
SGSSSNIGSHTVN

SEQ ID NO: 533 - protein, 7 aa, Artificial Sequence
  TPP-21045_17578-gl79-hIgG1-wt-Lambda_LCDR2
RNNQRPS

SEQ ID NO: 534 - protein, 11 aa, Artificial Sequence
  TPP-21045_17578-gl79-hIgG1-wt-Lambda_LCDR3
AAWDDSLNGWV

SEQ ID NO: 535 - DNA, 363 bp, Artificial Sequence
  TPP-21045_17578-gl79-hIgG1-wt-Lambda_VH
gaagttcagctgctggaatctggcggcggactggttcaacctggcggatctctgagactgagctgtgccgccagcggcttcacattttctagcgcctggatgagctgggtccgacaggctcctggaaaaggcctggaatgggtgtccggcatctcttggagcggcggctctacaggatatgccctgtctgtgaagggcagattcaccatcagccgggacaacagcaagaacaccctgtacctgcagatgaacagcctgagagccgaggacaccgccgtgtactactgtgccagaacatacagcggccactacggccctttcttcgactattggggccagggcacactggtcacagtctcttca

SEQ ID NO: 536 - DNA, 15 bp, Artificial Sequence
  TPP-21045_17578-gl79-hIgG1-wt-Lambda_HCDR1
agcgcctggatgagc

SEQ ID NO: 537 - DNA, 51 bp, Artificial Sequence
  TPP-21045_17578-gl79-hIgG1-wt-Lambda_HCDR2
ggcatctcttggagcggcggctctacaggatatgccctgtctgtgaagggc

SEQ ID NO: 538 - DNA, 36 bp, Artificial Sequence
  TPP-21045_17578-gl79-hIgG1-wt-Lambda_HCDR3
acatacagcggccactacggccctttcttcgactat

SEQ ID NO: 539 - DNA, 330 bp, Artificial Sequence; identical to SEQ ID NO: 341
  TPP-21045_17578-gl79-hIgG1-wt-Lambda_VL

SEQ ID NO: 540 - DNA, 39 bp, Artificial Sequence; identical to SEQ ID NO: 342
  TPP-21045_17578-gl79-hIgG1-wt-Lambda_LCDR1

SEQ ID NO: 541 - DNA, 21 bp, Artificial Sequence
  TPP-21045_17578-gl79-hIgG1-wt-Lambda_LCDR2
aggaataatcagcggccctca

SEQ ID NO: 542 - DNA, 33 bp, Artificial Sequence; identical to SEQ ID NO: 344
  TPP-21045_17578-gl79-hIgG1-wt-Lambda_LCDR3

SEQ ID NO: 543 - protein, 451 aa, Artificial Sequence
  TPP-21045_17578-gl79-hIgG1-wt-Lambda_Heavy Chain
EVQLLESGGGLVQPGGSLRLSCAASGFTFSSAWMSWVRQAPGKGLEWVSGISWSGGSTGYALSVKGRFTISRDNSKNTLYLQMNSLRAEDTAVYYCARTYSGHYGPFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 544 - protein, 216 aa, Artificial Sequence; identical to SEQ ID NO: 346
  TPP-21045_17578-gl79-hIgG1-wt-Lambda_Light Chain

SEQ ID NO: 545 - protein, 121 aa, Artificial Sequence
  TPP-21047_17578-gl81-hIgG1-wt-Lambda_VH
EVQLLESGGGLVQPGGSLRLSCAASGFTFSSAWMSWVRQAPGKGLEWVSGISWSGGRTGYALSVKGRFTISRDNSKNTLYLQMNSLRAEDTAVYYCARTYSGHYGPYFDYWGQGTLVTVSS

SEQ ID NO: 546 - protein, 5 aa, Artificial Sequence
  TPP-21047_17578-gl81-hIgG1-wt-Lambda_HCDR1
SAWMS

SEQ ID NO: 547 - protein, 17 aa, Artificial Sequence
  TPP-21047_17578-gl81-hIgG1-wt-Lambda_HCDR2
GISWSGGRTGYALSVKG

SEQ ID NO: 548 - protein, 12 aa, Artificial Sequence
  TPP-21047_17578-gl81-hIgG1-wt-Lambda_HCDR3
TYSGHYGPYFDY

SEQ ID NO: 549 - protein, 110 aa, Artificial Sequence; identical to SEQ ID NO: 333
  TPP-21047_17578-gl81-hIgG1-wt-Lambda_VL

SEQ ID NO: 550 - protein, 13 aa, Artificial Sequence
  TPP-21047_17578-gl81-hIgG1-wt-Lambda_LCDR1
SGSSSNIGSHTVN

SEQ ID NO: 551 - protein, 7 aa, Artificial Sequence
  TPP-21047_17578-gl81-hIgG1-wt-Lambda_LCDR2
RNNQRPS

SEQ ID NO: 552 - protein, 11 aa, Artificial Sequence
  TPP-21047_17578-gl81-hIgG1-wt-Lambda_LCDR3
AAWDDSLNGWV

SEQ ID NO: 553 - DNA, 363 bp, Artificial Sequence
  TPP-21047_17578-gl81-hIgG1-wt-Lambda_VH
gaagttcagctgctggaatctggcggcggactggttcaacctggcggatctctgagactgagctgtgccgccagcggcttcacattttctagcgcctggatgagctgggtccgacaggctcctggaaaaggcctggaatgggtgtccggcatctcttggagcggcggcagaacaggatatgccctgtctgtgaagggcagattcaccatcagccgggacaacagcaagaacaccctgtacctgcagatgaacagcctgagagccgaggacaccgccgtgtactactgtgccagaacatacagcggccactacggcccctacttcgattattggggccagggcacactggtcaccgtttcttca

SEQ ID NO: 554 - DNA, 15 bp, Artificial Sequence
  TPP-21047_17578-gl81-hIgG1-wt-Lambda_HCDR1
agcgcctggatgagc

SEQ ID NO: 555 - DNA, 51 bp, Artificial Sequence
  TPP-21047_17578-gl81-hIgG1-wt-Lambda_HCDR2
ggcatctcttggagcggcggcagaacaggatatgccctgtctgtgaagggc

SEQ ID NO: 556 - DNA, 36 bp, Artificial Sequence; identical to SEQ ID NO: 466
  TPP-21047_17578-gl81-hIgG1-wt-Lambda_HCDR3

SEQ ID NO: 557 - DNA, 330 bp, Artificial Sequence; identical to SEQ ID NO: 341
  TPP-21047_17578-gl81-hIgG1-wt-Lambda_VL

SEQ ID NO: 558 - DNA, 39 bp, Artificial Sequence; identical to SEQ ID NO: 342
  TPP-21047_17578-gl81-hIgG1-wt-Lambda_LCDR1

SEQ ID NO: 559 - DNA, 21 bp, Artificial Sequence
  TPP-21047_17578-gl81-hIgG1-wt-Lambda_LCDR2
aggaataatcagcggccctca

SEQ ID NO: 560 - DNA, 33 bp, Artificial Sequence; identical to SEQ ID NO: 344
  TPP-21047_17578-gl81-hIgG1-wt-Lambda_LCDR3

SEQ ID NO: 561 - protein, 451 aa, Artificial Sequence
  TPP-21047_17578-gl81-hIgG1-wt-Lambda_Heavy Chain
EVQLLESGGGLVQPGGSLRLSCAASGFTFSSAWMSWVRQAPGKGLEWVSGISWSGGRTGYALSVKGRFTISRDNSKNTLYLQMNSLRAEDTAVYYCARTYSGHYGPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 216 aa, Artificial Sequence; identical to SEQ ID NO: 346
  TPP-21047_17578-gl81-hIgG1-wt-Lambda_Light Chain

SEQ ID NO: 563 - protein, 122 aa, Artificial Sequence
  TPP-21181_18205-gl46 -hIgG1-wt-Lambda_VH
EVQLLESGGGLVQPGGSLRLSCAASGFTFSSYAMSWVRQAPGKGLEWVSGIRWNNGSKGYAGSVKGRFTISRDNSKNTLYLQMNSLRAEDTAVYYCARSGNYYYGYHGMDVWGQGTLVTVSS

SEQ ID NO: 564 - protein, 5 aa, Artificial Sequence
  TPP-21181_18205-gl46 -hIgG1-wt-Lambda_HCDR1
SYAMS

SEQ ID NO: 565 - protein, 17 aa, Artificial Sequence
  TPP-21181_18205-gl46 -hIgG1-wt-Lambda_HCDR2
GIRWNNGSKGYAGSVKG

SEQ ID NO: 566 - protein, 13 aa, Artificial Sequence
  TPP-21181_18205-gl46 -hIgG1-wt-Lambda_HCDR3
SGNYYYGYHGMDV

SEQ ID NO: 567 - protein, 108 aa, Artificial Sequence; identical to SEQ ID NO: 405
  TPP-21181_18205-gl46 -hIgG1-wt-Lambda_VL

SEQ ID NO: 568 - protein, 13 aa, Artificial Sequence
  TPP-21181_18205-gl46 -hIgG1-wt-Lambda_LCDR1
SGGNSNIGTYFVS

SEQ ID NO: 569 - protein, 7 aa, Artificial Sequence
  TPP-21181_18205-gl46 -hIgG1-wt-Lambda_LCDR2
TNNQRPS

SEQ ID NO: 570 - protein, 9 aa, Artificial Sequence
  TPP-21181_18205-gl46 -hIgG1-wt-Lambda_LCDR3
ETWDSNTRV

SEQ ID NO: 571 - DNA, 366 bp, Artificial Sequence
  TPP-21181_18205-gl46 -hIgG1-wt-Lambda_VH
gaagttcagctgctggaatctggcggcggactggttcaacctggcggatctctgagactgagctgtgccgccagcggcttcacctttagcagctacgccatgagctgggtccgacaggctcctggcaaaggccttgaatgggtgtccggcatcagatggaacaacggcagcaagggctatgccggctctgtgaagggcagattcaccatcagccgggacaacagcaagaacaccctgtacctgcagatgaacagcctgagagccgaggacaccgccgtgtactactgtgccagaagcggcaactactactacggctaccacggcatggatgtgtggggccagggaacactggttaccgtttcttca

SEQ ID NO: 572 - DNA, 15 bp, Artificial Sequence
  TPP-21181_18205-gl46 -hIgG1-wt-Lambda_HCDR1
agctacgccatgagc

SEQ ID NO: 573 - DNA, 51 bp, Artificial Sequence
  TPP-21181_18205-gl46 -hIgG1-wt-Lambda_HCDR2
ggcatcagatggaacaacggcagcaagggctatgccggctctgtgaagggc

SEQ ID NO: 574 - DNA, 39 bp, Artificial Sequence
  TPP-21181_18205-gl46 -hIgG1-wt-Lambda_HCDR3
agcggcaactactactacggctaccacggcatggatgtg

SEQ ID NO: 575 - DNA, 324 bp, Artificial Sequence; identical to SEQ ID NO: 413
  TPP-21181_18205-gl46 -hIgG1-wt-Lambda_VL

SEQ ID NO: 576 - DNA, 39 bp, Artificial Sequence; identical to SEQ ID NO: 414
  TPP-21181_18205-gl46 -hIgG1-wt-Lambda_LCDR1

SEQ ID NO: 577 - DNA, 21 bp, Artificial Sequence
  TPP-21181_18205-gl46 -hIgG1-wt-Lambda_LCDR2
accaacaaccagcggcctagc

SEQ ID NO: 578 - DNA, 27 bp, Artificial Sequence
  TPP-21181_18205-gl46 -hIgG1-wt-Lambda_LCDR3
gagacatgggacagcaacaccagagtg

SEQ ID NO: 579 - protein, 452 aa, Artificial Sequence
  TPP-21181_18205-gl46 -hIgG1-wt-Lambda_Heavy Chain
EVQLLESGGGLVQPGGSLRLSCAASGFTFSSYAMSWVRQAPGKGLEWVSGIRWNNGSKGYAGSVKGRFTISRDNSKNTLYLQMNSLRAEDTAVYYCARSGNYYYGYHGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 580 - protein, 214 aa, Artificial Sequence; identical to SEQ ID NO: 418
  TPP-21181_18205-gl46 -hIgG1-wt-Lambda_Light Chain

SEQ ID NO: 581 - protein, 122 aa, Artificial Sequence
  TPP-21183_18205-gl48 -hIgG1-wt-Lambda_VH
EVQLLESGGGLVQPGGSLRLSCAASGFTFSSYAMSWVRQAPGKGLEWVSGIRWNNGSKGYAGSVKGRFTISRDNSKNTLYLQMNSLRAEDTAVYYCARSGNEYYGYHGMDVWGQGTLVTVSS

SEQ ID NO: 582 - protein, 5 aa, Artificial Sequence
  TPP-21183_18205-gl48 -hIgG1-wt-Lambda_HCDR1
SYAMS

SEQ ID NO: 583 - protein, 17 aa, Artificial Sequence
  TPP-21183_18205-gl48 -hIgG1-wt-Lambda_HCDR2
GIRWNNGSKGYAGSVKG

SEQ ID NO: 584 - protein, 13 aa, Artificial Sequence
  TPP-21183_18205-gl48 -hIgG1-wt-Lambda_HCDR3
SGNEYYGYHGMDV

SEQ ID NO: 585 - protein, 108 aa, Artificial Sequence; identical to SEQ ID NO: 405
  TPP-21183_18205-gl48 -hIgG1-wt-Lambda_VL

SEQ ID NO: 586 - protein, 13 aa, Artificial Sequence
  TPP-21183_18205-gl48 -hIgG1-wt-Lambda_LCDR1
SGGNSNIGTYFVS

SEQ ID NO: 587 - protein, 7 aa, Artificial Sequence
  TPP-21183_18205-gl48 -hIgG1-wt-Lambda_LCDR2
TNNQRPS

SEQ ID NO: 588 - protein, 9 aa, Artificial Sequence
  TPP-21183_18205-gl48 -hIgG1-wt-Lambda_LCDR3
ETWDSNTRV

SEQ ID NO: 589 - DNA, 366 bp, Artificial Sequence
  TPP-21183_18205-gl48 -hIgG1-wt-Lambda_VH
gaagttcagctgctggaatctggcggcggactggttcaacctggcggatctctgagactgagctgtgccgccagcggcttcacctttagcagctacgccatgagctgggtccgacaggctcctggcaaaggccttgaatgggtgtccggcatcagatggaacaacggcagcaagggctatgccggctctgtgaagggcagattcaccatcagccgggacaacagcaagaacaccctgtacctgcagatgaacagcctgagagccgaggacaccgccgtgtactactgtgccagaagcggcaacgagtactacggctaccacggcatggatgtgtggggccagggaacactggttaccgtttcttca

SEQ ID NO: 590 - DNA, 15 bp, Artificial Sequence
  TPP-21183_18205-gl48 -hIgG1-wt-Lambda_HCDR1
agctacgccatgagc

SEQ ID NO: 591 - DNA, 51 bp, Artificial Sequence; identical to SEQ ID NO: 573
  TPP-21183_18205-gl48 -hIgG1-wt-Lambda_HCDR2

SEQ ID NO: 592 - DNA, 39 bp, Artificial Sequence
  TPP-21183_18205-gl48 -hIgG1-wt-Lambda_HCDR3
agcggcaacgagtactacggctaccacggcatggatgtg

SEQ ID NO: 593 - DNA, 324 bp, Artificial Sequence; identical to SEQ ID NO: 413
  TPP-21183_18205-gl48 -hIgG1-wt-Lambda_VL

SEQ ID NO: 594 - DNA, 39 bp, Artificial Sequence; identical to SEQ ID NO: 414
  TPP-21183_18205-gl48 -hIgG1-wt-Lambda_LCDR1

SEQ ID NO: 595 - DNA, 21 bp, Artificial Sequence
  TPP-21183_18205-gl48 -hIgG1-wt-Lambda_LCDR2
accaacaaccagcggcctagc

SEQ ID NO: 596 - DNA, 27 bp, Artificial Sequence
  TPP-21183_18205-gl48 -hIgG1-wt-Lambda_LCDR3
gagacatgggacagcaacaccagagtg

SEQ ID NO: 597 - protein, 452 aa, Artificial Sequence
  TPP-21183_18205-gl48 -hIgG1-wt-Lambda_Heavy Chain
EVQLLESGGGLVQPGGSLRLSCAASGFTFSSYAMSWVRQAPGKGLEWVSGIRWNNGSKGYAGSVKGRFTISRDNSKNTLYLQMNSLRAEDTAVYYCARSGNEYYGYHGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 598 - protein, 214 aa, Artificial Sequence; identical to SEQ ID NO: 418
  TPP-21183_18205-gl48 -hIgG1-wt-Lambda_Light Chain

SEQ ID NO: 599 - protein, 122 aa, Artificial Sequence
  TPP-21360_18206-gl25-gl13-hIgG1Lambda_VH
EVQLLESGGGLVQPGGSLRLSCAASGFTFSSYGMHWVRQAPGKGLEWVSAINWNGGSTGYADSVKGRFTISRDNSKNTLYLQMNSLRAEDTAVYYCARGHHSGYDGRFFDYWGQGTLVTVSS

SEQ ID NO: 600 - protein, 5 aa, Artificial Sequence
  TPP-21360_18206-gl25-gl13-hIgG1Lambda_HCDR1
SYGMH

SEQ ID NO: 601 - protein, 17 aa, Artificial Sequence
  TPP-21360_18206-gl25-gl13-hIgG1Lambda_HCDR2
AINWNGGSTGYADSVKG

SEQ ID NO: 602 - protein, 13 aa, Artificial Sequence
  TPP-21360_18206-gl25-gl13-hIgG1Lambda_HCDR3
GHHSGYDGRFFDY

SEQ ID NO: 603 - protein, 111 aa, Artificial Sequence; identical to SEQ ID NO: 477
  TPP-21360_18206-gl25-gl13-hIgG1Lambda_VL

SEQ ID NO: 604 - protein, 14 aa, Artificial Sequence
  TPP-21360_18206-gl25-gl13-hIgG1Lambda_LCDR1
TGSSSNIGAGYNVH

SEQ ID NO: 605 - protein, 7 aa, Artificial Sequence
  TPP-21360_18206-gl25-gl13-hIgG1Lambda_LCDR2
TNNRRPS

SEQ ID NO: 606 - protein, 11 aa, Artificial Sequence
  TPP-21360_18206-gl25-gl13-hIgG1Lambda_LCDR3
AAWDASLSGWV

SEQ ID NO: 607 - DNA, 366 bp, Artificial Sequence
  TPP-21360_18206-gl25-gl13-hIgG1Lambda_VH
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttca

SEQ ID NO: 608 - DNA, 15 bp, Artificial Sequence
  TPP-21360_18206-gl25-gl13-hIgG1Lambda_HCDR1
agctatggcatgcac

SEQ ID NO: 609 - DNA, 51 bp, Artificial Sequence
  TPP-21360_18206-gl25-gl13-hIgG1Lambda_HCDR2
gccatcaactggaatggcggctctacaggctacgccgactctgtgaagggc

SEQ ID NO: 610 - DNA, 39 bp, Artificial Sequence; identical to SEQ ID NO: 430
  TPP-21360_18206-gl25-gl13-hIgG1Lambda_HCDR3

SEQ ID NO: 611 - DNA, 333 bp, Artificial Sequence; identical to SEQ ID NO: 485
  TPP-21360_18206-gl25-gl13-hIgG1Lambda_VL

SEQ ID NO: 612 - DNA, 42 bp, Artificial Sequence; identical to SEQ ID NO: 486
  TPP-21360_18206-gl25-gl13-hIgG1Lambda_LCDR1

SEQ ID NO: 613 - DNA, 21 bp, Artificial Sequence
  TPP-21360_18206-gl25-gl13-hIgG1Lambda_LCDR2
accaacaacagacggcccagc

SEQ ID NO: 614 - DNA, 33 bp, Artificial Sequence; identical to SEQ ID NO: 434
  TPP-21360_18206-gl25-gl13-hIgG1Lambda_LCDR3

SEQ ID NO: 615 - protein, 451 aa, Artificial Sequence
  TPP-21360_18206-gl25-gl13-hIgG1Lambda_Heavy Chain
EVQLLESGGGLVQPGGSLRLSCAASGFTFSSYGMHWVRQAPGKGLEWVSAINWNGGSTGYADSVKGRFTISRDNSKNTLYLQMNSLRAEDTAVYYCARGHHSGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 616 - protein, 217 aa, Artificial Sequence; identical to SEQ ID NO: 490
  TPP-21360_18206-gl25-gl13-hIgG1Lambda_Light Chain

SEQ ID NO: 617 - protein, 122 aa, Artificial Sequence; identical to SEQ ID NO: 599
  TPP-23411_21360-hIgG1wtlambda_VH

SEQ ID NO: 618 - protein, 5 aa, Artificial Sequence
  TPP-23411_21360-hIgG1wtlambda_HCDR1
SYGMH

SEQ ID NO: 619 - protein, 17 aa, Artificial Sequence
  TPP-23411_21360-hIgG1wtlambda_HCDR2
AINWNGGSTGYADSVKG

SEQ ID NO: 620 - protein, 13 aa, Artificial Sequence
  TPP-23411_21360-hIgG1wtlambda_HCDR3
GHHSGYDGRFFDY

SEQ ID NO: 621 - protein, 111 aa, Artificial Sequence; identical to SEQ ID NO: 477
  TPP-23411_21360-hIgG1wtlambda_VL

SEQ ID NO: 622 - protein, 14 aa, Artificial Sequence
  TPP-23411_21360-hIgG1wtlambda_LCDR1
TGSSSNIGAGYNVH

SEQ ID NO: 623 - protein, 7 aa, Artificial Sequence
  TPP-23411_21360-hIgG1wtlambda_LCDR2
TNNRRPS

SEQ ID NO: 624 - protein, 11 aa, Artificial Sequence
  TPP-23411_21360-hIgG1wtlambda_LCDR3
AAWDASLSGWV

SEQ ID NO: 625 - DNA, 366 bp, Artificial Sequence
  TPP-23411_21360-hIgG1wtlambda_VH
gaggtgcagctgctggaatctggcggaggattggttcagcctggcggctctctgagactgtcttgtgccgcttccggcttcaccttctccagctacggaatgcactgggtccgacaggcccctggcaaaggattggaatgggtgtccgccatcaactggaacggcggctctaccggctacgccgattctgtgaagggcagattcaccatcagccgggacaactccaagaacaccctgtacctgcagatgaactccctgagagccgaggacaccgccgtgtactattgtgctagaggccaccactctggctacgacggcagattcttcgactattggggccagggcaccctggtcacagtttcttca

SEQ ID NO: 626 - DNA, 15 bp, Artificial Sequence
  TPP-23411_21360-hIgG1wtlambda_HCDR1
agctacggaatgcac

SEQ ID NO: 627 - DNA, 51 bp, Artificial Sequence
  TPP-23411_21360-hIgG1wtlambda_HCDR2
gccatcaactggaacggcggctctaccggctacgccgattctgtgaagggc

SEQ ID NO: 628 - DNA, 39 bp, Artificial Sequence
  TPP-23411_21360-hIgG1wtlambda_HCDR3
ggccaccactctggctacgacggcagattcttcgactat

SEQ ID NO: 629 - DNA, 333 bp, Artificial Sequence; identical to SEQ ID NO: 485
  TPP-23411_21360-hIgG1wtlambda_VL

SEQ ID NO: 630 - DNA, 42 bp, Artificial Sequence; identical to SEQ ID NO: 486
  TPP-23411_21360-hIgG1wtlambda_LCDR1

SEQ ID NO: 631 - DNA, 21 bp, Artificial Sequence
  TPP-23411_21360-hIgG1wtlambda_LCDR2
accaacaacagacggcccagc

SEQ ID NO: 632 - DNA, 33 bp, Artificial Sequence; identical to SEQ ID NO: 434
  TPP-23411_21360-hIgG1wtlambda_LCDR3

SEQ ID NO: 633 - protein, 452 aa, Artificial Sequence
  TPP-23411_21360-hIgG1wtlambda_Heavy Chain
EVQLLESGGGLVQPGGSLRLSCAASGFTFSSYGMHWVRQAPGKGLEWVSAINWNGGSTGYADSVKGRFTISRDNSKNTLYLQMNSLRAEDTAVYYCARGHHSGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 634 - protein, 217 aa, Artificial Sequence; identical to SEQ ID NO: 490
  TPP-23411_21360-hIgG1wtlambda_Light Chain

SEQ ID NO: 635-659 - skipped (25 entries)

SEQ ID NO: 660 - protein, 122 aa, Artificial Sequence
  TPP-29596_18206-gl13-gl14-hIgG1wtLambda_VH_PRT
EVQLLESGGGLVQPGGSLRLSCAASGFTFSSYGMHWVRQAPGKGLEWVSGINWNGGSTGYADSVKGRFTISRDNSKNTLYLQMNSLRAEDTAVYYCARGHHSGYDGRFFDYWGQGTLVTVSS

SEQ ID NO: 661 - protein, 5 aa, Artificial Sequence
  TPP-29596_18206-gl13-gl14-hIgG1wtLambda_HCDR1_PRT
SYGMH

SEQ ID NO: 662 - protein, 17 aa, Artificial Sequence
  TPP-29596_18206-gl13-gl14-hIgG1wtLambda_HCDR2_PRT
GINWNGGSTGYADSVKG

SEQ ID NO: 663 - protein, 13 aa, Artificial Sequence
  TPP-29596_18206-gl13-gl14-hIgG1wtLambda_HCDR3_PRT
GHHSGYDGRFFDY

SEQ ID NO: 664 - protein, 111 aa, Artificial Sequence; identical to SEQ ID NO: 477
  TPP-29596_18206-gl13-gl14-hIgG1wtLambda_VL_PRT

SEQ ID NO: 665 - protein, 14 aa, Artificial Sequence
  TPP-29596_18206-gl13-gl14-hIgG1wtLambda_LCDR1_PRT
TGSSSNIGAGYNVH

SEQ ID NO: 666 - protein, 7 aa, Artificial Sequence
  TPP-29596_18206-gl13-gl14-hIgG1wtLambda_LCDR2_PRT
TNNRRPS

SEQ ID NO: 667 - protein, 11 aa, Artificial Sequence
  TPP-29596_18206-gl13-gl14-hIgG1wtLambda_LCDR3_PRT
AAWDASLSGWV

SEQ ID NO: 668 - DNA, 366 bp, Artificial Sequence
  TPP-29596_18206-gl13-gl14-hIgG1wtLambda_VH_DNA
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccggcatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttca

SEQ ID NO: 669 - DNA, 15 bp, Artificial Sequence
  TPP-29596_18206-gl13-gl14-hIgG1wtLambda_HCDR1_DNA
agctatggcatgcac

SEQ ID NO: 670 - DNA, 51 bp, Artificial Sequence; identical to SEQ ID NO: 429
  TPP-29596_18206-gl13-gl14-hIgG1wtLambda_HCDR2_DNA

SEQ ID NO: 671 - DNA, 39 bp, Artificial Sequence; identical to SEQ ID NO: 430
  TPP-29596_18206-gl13-gl14-hIgG1wtLambda_HCDR3_DNA

SEQ ID NO: 672 - DNA, 333 bp, Artificial Sequence; identical to SEQ ID NO: 485
  TPP-29596_18206-gl13-gl14-hIgG1wtLambda_VL_DNA

SEQ ID NO: 673 - DNA, 42 bp, Artificial Sequence; identical to SEQ ID NO: 486
  TPP-29596_18206-gl13-gl14-hIgG1wtLambda_LCDR1_DNA

SEQ ID NO: 674 - DNA, 21 bp, Artificial Sequence
  TPP-29596_18206-gl13-gl14-hIgG1wtLambda_LCDR2_DNA
accaacaacagacggcccagc

SEQ ID NO: 675 - DNA, 33 bp, Artificial Sequence; identical to SEQ ID NO: 434
  TPP-29596_18206-gl13-gl14-hIgG1wtLambda_LCDR3_DNA

SEQ ID NO: 676 - protein, 452 aa, Artificial Sequence
  TPP-29596_18206-gl13-gl14-hIgG1wtLambda_HC_PRT
EVQLLESGGGLVQPGGSLRLSCAASGFTFSSYGMHWVRQAPGKGLEWVSGINWNGGSTGYADSVKGRFTISRDNSKNTLYLQMNSLRAEDTAVYYCARGHHSGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 677 - protein, 217 aa, Artificial Sequence; identical to SEQ ID NO: 490
  TPP-29596_18206-gl13-gl14-hIgG1wtLambda_LC_PRT

SEQ ID NO: 678 - DNA, 1356 bp, Artificial Sequence
  TPP-29596_18206-gl13-gl14-hIgG1wtLambda_HC_DNA
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccggcatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggcaag

SEQ ID NO: 679 - DNA, 651 bp, Artificial Sequence
  TPP-29596_18206-gl13-gl14-hIgG1wtLambda_LC_DNA
cagtctgttctgacacagcctccatctgtgtctggcgcccctggacagagagtgaccatcagctgtacaggcagcagctccaatatcggagccggctacaacgtgcactggtatcagcagctgcctggcacagcccctaaactgctgatctacaccaacaacagacggcccagcggcgtgcccgatagattttctggcagcaagagcggcacaagcgccagcctggctatctctggactgagatctgaggacgaggccgactactattgcgccgcctgggatgcttctctgagcggatgggttttcggcggaggcaccaaactgacagtgctaggccagcctaaagccgcccctagcgtgaccctgttccctccaagcagcgaggaactgcaggccaacaaggccaccctcgtgtgcctgatcagcgacttctatcctggcgccgtgaccgtggcctggaaggccgatagctctcctgtgaaggccggcgtggaaaccaccacccctagcaagcagagcaacaacaaatacgccgccagcagctacctgagcctgacccccgagcagtggaagtcccacagatcctacagctgccaagtgacccacgagggcagcaccgtggaaaagacagtggcccctaccgagtgcagc

SEQ ID NO: 680 - protein, 122 aa, Artificial Sequence; identical to SEQ ID NO: 599
  TPP-29597_18206-gl11-gl25-hIgG1wtLambda_VH_PRT

SEQ ID NO: 681 - protein, 5 aa, Artificial Sequence
  TPP-29597_18206-gl11-gl25-hIgG1wtLambda_HCDR1_PRT
SYGMH

SEQ ID NO: 682 - protein, 17 aa, Artificial Sequence
  TPP-29597_18206-gl11-gl25-hIgG1wtLambda_HCDR2_PRT
AINWNGGSTGYADSVKG

SEQ ID NO: 683 - protein, 13 aa, Artificial Sequence
  TPP-29597_18206-gl11-gl25-hIgG1wtLambda_HCDR3_PRT
GHHSGYDGRFFDY

SEQ ID NO: 684 - protein, 111 aa, Artificial Sequence
  TPP-29597_18206-gl11-gl25-hIgG1wtLambda_VL_PRT
QSVLTQPPSASGAPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVL

SEQ ID NO: 685 - protein, 14 aa, Artificial Sequence
  TPP-29597_18206-gl11-gl25-hIgG1wtLambda_LCDR1_PRT
TGSSSNIGAGYNVH

SEQ ID NO: 686 - protein, 7 aa, Artificial Sequence
  TPP-29597_18206-gl11-gl25-hIgG1wtLambda_LCDR2_PRT
TNNRRPS

SEQ ID NO: 687 - protein, 11 aa, Artificial Sequence
  TPP-29597_18206-gl11-gl25-hIgG1wtLambda_LCDR3_PRT
AAWDASLSGWV

SEQ ID NO: 688 - DNA, 366 bp, Artificial Sequence; identical to SEQ ID NO: 607
  TPP-29597_18206-gl11-gl25-hIgG1wtLambda_VH_DNA

SEQ ID NO: 689 - DNA, 15 bp, Artificial Sequence
  TPP-29597_18206-gl11-gl25-hIgG1wtLambda_HCDR1_DNA
agctatggcatgcac

SEQ ID NO: 690 - DNA, 51 bp, Artificial Sequence; identical to SEQ ID NO: 609
  TPP-29597_18206-gl11-gl25-hIgG1wtLambda_HCDR2_DNA

SEQ ID NO: 691 - DNA, 39 bp, Artificial Sequence; identical to SEQ ID NO: 430
  TPP-29597_18206-gl11-gl25-hIgG1wtLambda_HCDR3_DNA

SEQ ID NO: 692 - DNA, 333 bp, Artificial Sequence
  TPP-29597_18206-gl11-gl25-hIgG1wtLambda_VL_DNA
cagtctgttctgacacagcctccatctgctagcggagcccctggacagagagtgaccatcagctgtacaggcagcagctccaatatcggagccggctacaacgtgcactggtatcagcagctgcctggcacagcccctaaactgctgatctacaccaacaacagacggcccagcggcgtgcccgatagattttctggcagcaagagcggcacaagcgccagcctggctatctctggactgagatctgaggacgaggccgactactattgcgccgcctgggatgcttctctgagcggatgggttttcggcggaggcaccaaactgacagtgcta

SEQ ID NO: 693 - DNA, 42 bp, Artificial Sequence; identical to SEQ ID NO: 486
  TPP-29597_18206-gl11-gl25-hIgG1wtLambda_LCDR1_DNA

SEQ ID NO: 694 - DNA, 21 bp, Artificial Sequence
  TPP-29597_18206-gl11-gl25-hIgG1wtLambda_LCDR2_DNA
accaacaacagacggcccagc

SEQ ID NO: 695 - DNA, 33 bp, Artificial Sequence; identical to SEQ ID NO: 434
  TPP-29597_18206-gl11-gl25-hIgG1wtLambda_LCDR3_DNA

SEQ ID NO: 696 - protein, 452 aa, Artificial Sequence; identical to SEQ ID NO: 633
  TPP-29597_18206-gl11-gl25-hIgG1wtLambda_HC_PRT

SEQ ID NO: 697 - protein, 217 aa, Artificial Sequence
  TPP-29597_18206-gl11-gl25-hIgG1wtLambda_LC_PRT
QSVLTQPPSASGAPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 698 - DNA, 1356 bp, Artificial Sequence
  TPP-29597_18206-gl11-gl25-hIgG1wtLambda_HC_DNA
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggcaag

SEQ ID NO: 699 - DNA, 651 bp, Artificial Sequence
  TPP-29597_18206-gl11-gl25-hIgG1wtLambda_LC_DNA
cagtctgttctgacacagcctccatctgctagcggagcccctggacagagagtgaccatcagctgtacaggcagcagctccaatatcggagccggctacaacgtgcactggtatcagcagctgcctggcacagcccctaaactgctgatctacaccaacaacagacggcccagcggcgtgcccgatagattttctggcagcaagagcggcacaagcgccagcctggctatctctggactgagatctgaggacgaggccgactactattgcgccgcctgggatgcttctctgagcggatgggttttcggcggaggcaccaaactgacagtgctaggccagcctaaagccgcccctagcgtgaccctgttccctccaagcagcgaggaactgcaggccaacaaggccaccctcgtgtgcctgatcagcgacttctatcctggcgccgtgaccgtggcctggaaggccgatagctctcctgtgaaggccggcgtggaaaccaccacccctagcaagcagagcaacaacaaatacgccgccagcagctacctgagcctgacccccgagcagtggaagtcccacagatcctacagctgccaagtgacccacgagggcagcaccgtggaaaagacagtggcccctaccgagtgcagc

SEQ ID NO: 700 - DNA, 1353 bp, Artificial Sequence
  TPP-18206_002-F01_497A-M281-P02+497A-M317-O07-hIgG1Lambda_HC_DNA
gaagttcagctgctggaatctggcggcggactggttcaacctggcggatctctgagactgagctgtgccgccagcggcttcacctttagccactatggcatgcactgggtccgacaggcccctggcaaaggacttgaatgggtgtccggcatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggc

SEQ ID NO: 701 - DNA, 651 bp, Artificial Sequence
  TPP-18206_002-F01_497A-M281-P02+497A-M317-O07-hIgG1Lambda_LC_DNA
cagtctgttctgacacagcctcctagcgcctctggcacacctggacagagagtgaccatcagctgtaccggcagcagctccaatatcggagccggctacaacgtgcactggtatcagcagctgcctggcacagcccctaaactgctgatctacaccaacaacagacggcccagcggcgtgcccgatagattttctggcagcaagagcggcacaagcgccagcctggctatctctggactgagatctgaggacgaggccgactactattgcgccgcctgggatgcttctctgagcggatgggttttcggcggaggcaccaaactgacagtgctaggccagcctaaagccgcccctagcgtgaccctgttccctccaagcagcgaggaactgcaggccaacaaggccaccctcgtgtgcctgatcagcgacttctatcctggcgccgtgaccgtggcctggaaggccgatagctctcctgtgaaggccggcgtggaaaccaccacccctagcaagcagagcaacaacaaatacgccgccagcagctacctgagcctgacccccgagcagtggaagtcccacagatcctacagctgccaagtgacccacgagggcagcaccgtggaaaagacagtggcccctaccgagtgcagc

SEQ ID NO: 702 - protein, 122 aa, Artificial Sequence; identical to SEQ ID NO: 419
  TPP-18429_18206-gl10-hIgG1Lambda_VH_PRT

SEQ ID NO: 703 - protein, 5 aa, Artificial Sequence
  TPP-18429_18206-gl10-hIgG1Lambda_HCDR1_PRT
HYGMH

SEQ ID NO: 704 - protein, 17 aa, Artificial Sequence
  TPP-18429_18206-gl10-hIgG1Lambda_HCDR2_PRT
GINWNGGSTGYADSVKG

SEQ ID NO: 705 - protein, 13 aa, Artificial Sequence
  TPP-18429_18206-gl10-hIgG1Lambda_HCDR3_PRT
GHHSGYDGRFFDY

SEQ ID NO: 706 - protein, 111 aa, Artificial Sequence
  TPP-18429_18206-gl10-hIgG1Lambda_VL_PRT
QSVLTQPPSVSGTPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVL

SEQ ID NO: 707 - protein, 14 aa, Artificial Sequence
  TPP-18429_18206-gl10-hIgG1Lambda_LCDR1_PRT
TGSSSNIGAGYNVH

SEQ ID NO: 708 - protein, 7 aa, Artificial Sequence
  TPP-18429_18206-gl10-hIgG1Lambda_LCDR2_PRT
TNNRRPS

SEQ ID NO: 709 - protein, 11 aa, Artificial Sequence
  TPP-18429_18206-gl10-hIgG1Lambda_LCDR3_PRT
AAWDASLSGWV

SEQ ID NO: 710 - DNA, 366 bp, Artificial Sequence; identical to SEQ ID NO: 427
  TPP-18429_18206-gl10-hIgG1Lambda_VH_DNA

SEQ ID NO: 711 - DNA, 15 bp, Artificial Sequence
  TPP-18429_18206-gl10-hIgG1Lambda_HCDR1_DNA
cactatggcatgcac

SEQ ID NO: 712 - DNA, 51 bp, Artificial Sequence; identical to SEQ ID NO: 429
  TPP-18429_18206-gl10-hIgG1Lambda_HCDR2_DNA

SEQ ID NO: 713 - DNA, 39 bp, Artificial Sequence; identical to SEQ ID NO: 430
  TPP-18429_18206-gl10-hIgG1Lambda_HCDR3_DNA

SEQ ID NO: 714 - DNA, 333 bp, Artificial Sequence
  TPP-18429_18206-gl10-hIgG1Lambda_VL_DNA
cagtctgttctgacacagcctccatccgtgtctggcacacctggccagagagtgaccatcagctgtaccggcagcagctccaatatcggagccggctacaacgtgcactggtatcagcagctgcctggcacagcccctaaactgctgatctacaccaacaacagacggcccagcggcgtgcccgatagattttctggctctaagagcggcaccagcgccagcctggctatctctggactgagatctgaggacgaggccgactactattgcgccgcctgggatgcttctctgagcggatgggttttcggcggaggcaccaaactgacagtgcta

SEQ ID NO: 715 - DNA, 42 bp, Artificial Sequence; identical to SEQ ID NO: 432
  TPP-18429_18206-gl10-hIgG1Lambda_LCDR1_DNA

SEQ ID NO: 716 - DNA, 21 bp, Artificial Sequence
  TPP-18429_18206-gl10-hIgG1Lambda_LCDR2_DNA
accaacaacagacggcccagc

SEQ ID NO: 717 - DNA, 33 bp, Artificial Sequence; identical to SEQ ID NO: 434
  TPP-18429_18206-gl10-hIgG1Lambda_LCDR3_DNA

SEQ ID NO: 718 - protein, 451 aa, Artificial Sequence; identical to SEQ ID NO: 435
  TPP-18429_18206-gl10-hIgG1Lambda_HC_PRT

SEQ ID NO: 719 - protein, 217 aa, Artificial Sequence
  TPP-18429_18206-gl10-hIgG1Lambda_LC_PRT
QSVLTQPPSVSGTPGQRVTISCTGSSSNIGAGYNVHWYQQLPGTAPKLLIYTNNRRPSGVPDRFSGSKSGTSASLAISGLRSEDEADYYCAAWDASLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 720 - DNA, 1353 bp, Artificial Sequence; identical to SEQ ID NO: 700
  TPP-18429_18206-gl10-hIgG1Lambda_HC_DNA

SEQ ID NO: 721 - DNA, 651 bp, Artificial Sequence
  TPP-18429_18206-gl10-hIgG1Lambda_LC_DNA
cagtctgttctgacacagcctccatccgtgtctggcacacctggccagagagtgaccatcagctgtaccggcagcagctccaatatcggagccggctacaacgtgcactggtatcagcagctgcctggcacagcccctaaactgctgatctacaccaacaacagacggcccagcggcgtgcccgatagattttctggctctaagagcggcaccagcgccagcctggctatctctggactgagatctgaggacgaggccgactactattgcgccgcctgggatgcttctctgagcggatgggttttcggcggaggcaccaaactgacagtgctaggccagcctaaagccgcccctagcgtgaccctgttccctccaagcagcgaggaactgcaggccaacaaggccaccctcgtgtgcctgatcagcgacttctatcctggcgccgtgaccgtggcctggaaggccgatagctctcctgtgaaggccggcgtggaaaccaccacccctagcaagcagagcaacaacaaatacgccgccagcagctacctgagcctgacccccgagcagtggaagtcccacagatcctacagctgccaagtgacccacgagggcagcaccgtggaaaagacagtggcccctaccgagtgcagc

SEQ ID NO: 722 - protein, 122 aa, Artificial Sequence; identical to SEQ ID NO: 419
  TPP-18430_18206-gl11-hIgG1Lambda_VH_PRT

SEQ ID NO: 723 - protein, 5 aa, Artificial Sequence
  TPP-18430_18206-gl11-hIgG1Lambda_HCDR1_PRT
HYGMH

SEQ ID NO: 724 - protein, 17 aa, Artificial Sequence
  TPP-18430_18206-gl11-hIgG1Lambda_HCDR2_PRT
GINWNGGSTGYADSVKG

SEQ ID NO: 725 - protein, 13 aa, Artificial Sequence
  TPP-18430_18206-gl11-hIgG1Lambda_HCDR3_PRT
GHHSGYDGRFFDY

SEQ ID NO: 726 - protein, 111 aa, Artificial Sequence; identical to SEQ ID NO: 684
  TPP-18430_18206-gl11-hIgG1Lambda_VL_PRT

SEQ ID NO: 727 - protein, 14 aa, Artificial Sequence
  TPP-18430_18206-gl11-hIgG1Lambda_LCDR1_PRT
TGSSSNIGAGYNVH

SEQ ID NO: 728 - protein, 7 aa, Artificial Sequence
  TPP-18430_18206-gl11-hIgG1Lambda_LCDR2_PRT
TNNRRPS

SEQ ID NO: 729 - protein, 11 aa, Artificial Sequence
  TPP-18430_18206-gl11-hIgG1Lambda_LCDR3_PRT
AAWDASLSGWV

SEQ ID NO: 730 - DNA, 366 bp, Artificial Sequence; identical to SEQ ID NO: 427
  TPP-18430_18206-gl11-hIgG1Lambda_VH_DNA

SEQ ID NO: 731 - DNA, 15 bp, Artificial Sequence
  TPP-18430_18206-gl11-hIgG1Lambda_HCDR1_DNA
cactatggcatgcac

SEQ ID NO: 732 - DNA, 51 bp, Artificial Sequence; identical to SEQ ID NO: 429
  TPP-18430_18206-gl11-hIgG1Lambda_HCDR2_DNA

SEQ ID NO: 733 - DNA, 39 bp, Artificial Sequence; identical to SEQ ID NO: 430
  TPP-18430_18206-gl11-hIgG1Lambda_HCDR3_DNA

SEQ ID NO: 734 - DNA, 333 bp, Artificial Sequence; identical to SEQ ID NO: 692
  TPP-18430_18206-gl11-hIgG1Lambda_VL_DNA

SEQ ID NO: 735 - DNA, 42 bp, Artificial Sequence; identical to SEQ ID NO: 486
  TPP-18430_18206-gl11-hIgG1Lambda_LCDR1_DNA

SEQ ID NO: 736 - DNA, 21 bp, Artificial Sequence
  TPP-18430_18206-gl11-hIgG1Lambda_LCDR2_DNA
accaacaacagacggcccagc

SEQ ID NO: 737 - DNA, 33 bp, Artificial Sequence; identical to SEQ ID NO: 434
  TPP-18430_18206-gl11-hIgG1Lambda_LCDR3_DNA

SEQ ID NO: 738 - protein, 451 aa, Artificial Sequence; identical to SEQ ID NO: 435
  TPP-18430_18206-gl11-hIgG1Lambda_HC_PRT

SEQ ID NO: 739 - protein, 217 aa, Artificial Sequence; identical to SEQ ID NO: 697
  TPP-18430_18206-gl11-hIgG1Lambda_LC_PRT

SEQ ID NO: 740 - DNA, 1353 bp, Artificial Sequence; identical to SEQ ID NO: 700
  TPP-18430_18206-gl11-hIgG1Lambda_HC_DNA

SEQ ID NO: 741 - DNA, 651 bp, Artificial Sequence; identical to SEQ ID NO: 699
  TPP-18430_18206-gl11-hIgG1Lambda_LC_DNA

SEQ ID NO: 742 - protein, 122 aa, Artificial Sequence; identical to SEQ ID NO: 419
  TPP-18432_18206-gl13-hIgG1Lambda_VH_PRT

SEQ ID NO: 743 - protein, 5 aa, Artificial Sequence
  TPP-18432_18206-gl13-hIgG1Lambda_HCDR1_PRT
HYGMH

SEQ ID NO: 744 - protein, 17 aa, Artificial Sequence
  TPP-18432_18206-gl13-hIgG1Lambda_HCDR2_PRT
GINWNGGSTGYADSVKG

SEQ ID NO: 745 - protein, 13 aa, Artificial Sequence
  TPP-18432_18206-gl13-hIgG1Lambda_HCDR3_PRT
GHHSGYDGRFFDY

SEQ ID NO: 746 - protein, 111 aa, Artificial Sequence; identical to SEQ ID NO: 477
  TPP-18432_18206-gl13-hIgG1Lambda_VL_PRT

SEQ ID NO: 747 - protein, 14 aa, Artificial Sequence
  TPP-18432_18206-gl13-hIgG1Lambda_LCDR1_PRT
TGSSSNIGAGYNVH

SEQ ID NO: 748 - protein, 7 aa, Artificial Sequence
  TPP-18432_18206-gl13-hIgG1Lambda_LCDR2_PRT
TNNRRPS

SEQ ID NO: 749 - protein, 11 aa, Artificial Sequence
  TPP-18432_18206-gl13-hIgG1Lambda_LCDR3_PRT
AAWDASLSGWV

SEQ ID NO: 750 - DNA, 366 bp, Artificial Sequence; identical to SEQ ID NO: 427
  TPP-18432_18206-gl13-hIgG1Lambda_VH_DNA

SEQ ID NO: 751 - DNA, 15 bp, Artificial Sequence
  TPP-18432_18206-gl13-hIgG1Lambda_HCDR1_DNA
cactatggcatgcac

SEQ ID NO: 752 - DNA, 51 bp, Artificial Sequence; identical to SEQ ID NO: 429
  TPP-18432_18206-gl13-hIgG1Lambda_HCDR2_DNA

SEQ ID NO: 753 - DNA, 39 bp, Artificial Sequence; identical to SEQ ID NO: 430
  TPP-18432_18206-gl13-hIgG1Lambda_HCDR3_DNA

SEQ ID NO: 754 - DNA, 333 bp, Artificial Sequence; identical to SEQ ID NO: 485
  TPP-18432_18206-gl13-hIgG1Lambda_VL_DNA

SEQ ID NO: 755 - DNA, 42 bp, Artificial Sequence; identical to SEQ ID NO: 486
  TPP-18432_18206-gl13-hIgG1Lambda_LCDR1_DNA

SEQ ID NO: 756 - DNA, 21 bp, Artificial Sequence
  TPP-18432_18206-gl13-hIgG1Lambda_LCDR2_DNA
accaacaacagacggcccagc

SEQ ID NO: 757 - DNA, 33 bp, Artificial Sequence; identical to SEQ ID NO: 434
  TPP-18432_18206-gl13-hIgG1Lambda_LCDR3_DNA

SEQ ID NO: 758 - protein, 451 aa, Artificial Sequence; identical to SEQ ID NO: 435
  TPP-18432_18206-gl13-hIgG1Lambda_HC_PRT

SEQ ID NO: 759 - protein, 217 aa, Artificial Sequence; identical to SEQ ID NO: 490
  TPP-18432_18206-gl13-hIgG1Lambda_LC_PRT

SEQ ID NO: 760 - DNA, 1353 bp, Artificial Sequence; identical to SEQ ID NO: 700
  TPP-18432_18206-gl13-hIgG1Lambda_HC_DNA

SEQ ID NO: 761 - DNA, 651 bp, Artificial Sequence; identical to SEQ ID NO: 679
  TPP-18432_18206-gl13-hIgG1Lambda_LC_DNA

SEQ ID NO: 762 - protein, 122 aa, Artificial Sequence; identical to SEQ ID NO: 660
  TPP-18433_18206-gl14-hIgG1Lambda_VH_PRT

SEQ ID NO: 763 - protein, 5 aa, Artificial Sequence
  TPP-18433_18206-gl14-hIgG1Lambda_HCDR1_PRT
SYGMH

SEQ ID NO: 764 - protein, 17 aa, Artificial Sequence
  TPP-18433_18206-gl14-hIgG1Lambda_HCDR2_PRT
GINWNGGSTGYADSVKG

SEQ ID NO: 765 - protein, 13 aa, Artificial Sequence
  TPP-18433_18206-gl14-hIgG1Lambda_HCDR3_PRT
GHHSGYDGRFFDY

SEQ ID NO: 766 - protein, 111 aa, Artificial Sequence; identical to SEQ ID NO: 423
  TPP-18433_18206-gl14-hIgG1Lambda_VL_PRT

SEQ ID NO: 767 - protein, 14 aa, Artificial Sequence
  TPP-18433_18206-gl14-hIgG1Lambda_LCDR1_PRT
TGSSSNIGAGYNVH

SEQ ID NO: 768 - protein, 7 aa, Artificial Sequence
  TPP-18433_18206-gl14-hIgG1Lambda_LCDR2_PRT
TNNRRPS

SEQ ID NO: 769 - protein, 11 aa, Artificial Sequence
  TPP-18433_18206-gl14-hIgG1Lambda_LCDR3_PRT
AAWDASLSGWV

SEQ ID NO: 770 - DNA, 366 bp, Artificial Sequence; identical to SEQ ID NO: 668
  TPP-18433_18206-gl14-hIgG1Lambda_VH_DNA

SEQ ID NO: 771 - DNA, 15 bp, Artificial Sequence
  TPP-18433_18206-gl14-hIgG1Lambda_HCDR1_DNA
agctatggcatgcac

SEQ ID NO: 772 - DNA, 51 bp, Artificial Sequence; identical to SEQ ID NO: 429
  TPP-18433_18206-gl14-hIgG1Lambda_HCDR2_DNA

SEQ ID NO: 773 - DNA, 39 bp, Artificial Sequence; identical to SEQ ID NO: 430
  TPP-18433_18206-gl14-hIgG1Lambda_HCDR3_DNA

SEQ ID NO: 774 - DNA, 333 bp, Artificial Sequence; identical to SEQ ID NO: 431
  TPP-18433_18206-gl14-hIgG1Lambda_VL_DNA

SEQ ID NO: 775 - DNA, 42 bp, Artificial Sequence; identical to SEQ ID NO: 432
  TPP-18433_18206-gl14-hIgG1Lambda_LCDR1_DNA

SEQ ID NO: 776 - DNA, 21 bp, Artificial Sequence
  TPP-18433_18206-gl14-hIgG1Lambda_LCDR2_DNA
accaacaacagacggcccagc

SEQ ID NO: 777 - DNA, 33 bp, Artificial Sequence; identical to SEQ ID NO: 434
  TPP-18433_18206-gl14-hIgG1Lambda_LCDR3_DNA

SEQ ID NO: 778 - protein, 451 aa, Artificial Sequence
  TPP-18433_18206-gl14-hIgG1Lambda_HC_PRT
EVQLLESGGGLVQPGGSLRLSCAASGFTFSSYGMHWVRQAPGKGLEWVSGINWNGGSTGYADSVKGRFTISRDNSKNTLYLQMNSLRAEDTAVYYCARGHHSGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 779 - protein, 217 aa, Artificial Sequence; identical to SEQ ID NO: 436
  TPP-18433_18206-gl14-hIgG1Lambda_LC_PRT

SEQ ID NO: 780 - DNA, 1353 bp, Artificial Sequence
  TPP-18433_18206-gl14-hIgG1Lambda_HC_DNA
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccggcatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggc

SEQ ID NO: 781 - DNA, 651 bp, Artificial Sequence; identical to SEQ ID NO: 701
  TPP-18433_18206-gl14-hIgG1Lambda_LC_DNA

SEQ ID NO: 782 - protein, 122 aa, Artificial Sequence
  TPP-18436_18206-gl17-hIgG1Lambda_VH_PRT
EVQLLESGGGLVQPGGSLRLSCAASGFTFSHYGMHWVRQAPGKGLEWVSAINWNGGSTGYADSVKGRFTISRDNSKNTLYLQMNSLRAEDTAVYYCARGHHSGYDGRFFDYWGQGTLVTVSS

SEQ ID NO: 783 - protein, 5 aa, Artificial Sequence
  TPP-18436_18206-gl17-hIgG1Lambda_HCDR1_PRT
HYGMH

SEQ ID NO: 784 - protein, 17 aa, Artificial Sequence
  TPP-18436_18206-gl17-hIgG1Lambda_HCDR2_PRT
AINWNGGSTGYADSVKG

SEQ ID NO: 785 - protein, 13 aa, Artificial Sequence
  TPP-18436_18206-gl17-hIgG1Lambda_HCDR3_PRT
GHHSGYDGRFFDY

SEQ ID NO: 786 - protein, 111 aa, Artificial Sequence; identical to SEQ ID NO: 423
  TPP-18436_18206-gl17-hIgG1Lambda_VL_PRT

SEQ ID NO: 787 - protein, 14 aa, Artificial Sequence
  TPP-18436_18206-gl17-hIgG1Lambda_LCDR1_PRT
TGSSSNIGAGYNVH

SEQ ID NO: 788 - protein, 7 aa, Artificial Sequence
  TPP-18436_18206-gl17-hIgG1Lambda_LCDR2_PRT
TNNRRPS

SEQ ID NO: 789 - protein, 11 aa, Artificial Sequence
  TPP-18436_18206-gl17-hIgG1Lambda_LCDR3_PRT
AAWDASLSGWV

SEQ ID NO: 790 - DNA, 366 bp, Artificial Sequence
  TPP-18436_18206-gl17-hIgG1Lambda_VH_DNA
gaagttcagctgctggaatctggcggcggactggttcaacctggcggatctctgagactgagctgtgccgccagcggcttcacctttagccactatggcatgcactgggtccgacaggcccctggcaaaggacttgaatgggtgtccgccatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttca

SEQ ID NO: 791 - DNA, 15 bp, Artificial Sequence
  TPP-18436_18206-gl17-hIgG1Lambda_HCDR1_DNA
cactatggcatgcac

SEQ ID NO: 792 - DNA, 51 bp, Artificial Sequence; identical to SEQ ID NO: 609
  TPP-18436_18206-gl17-hIgG1Lambda_HCDR2_DNA

SEQ ID NO: 793 - DNA, 39 bp, Artificial Sequence; identical to SEQ ID NO: 430
  TPP-18436_18206-gl17-hIgG1Lambda_HCDR3_DNA

SEQ ID NO: 794 - DNA, 333 bp, Artificial Sequence; identical to SEQ ID NO: 431
  TPP-18436_18206-gl17-hIgG1Lambda_VL_DNA

SEQ ID NO: 795 - DNA, 42 bp, Artificial Sequence; identical to SEQ ID NO: 432
  TPP-18436_18206-gl17-hIgG1Lambda_LCDR1_DNA

SEQ ID NO: 796 - DNA, 21 bp, Artificial Sequence
  TPP-18436_18206-gl17-hIgG1Lambda_LCDR2_DNA
accaacaacagacggcccagc

SEQ ID NO: 797 - DNA, 33 bp, Artificial Sequence; identical to SEQ ID NO: 434
  TPP-18436_18206-gl17-hIgG1Lambda_LCDR3_DNA

SEQ ID NO: 798 - protein, 451 aa, Artificial Sequence
  TPP-18436_18206-gl17-hIgG1Lambda_HC_PRT
EVQLLESGGGLVQPGGSLRLSCAASGFTFSHYGMHWVRQAPGKGLEWVSAINWNGGSTGYADSVKGRFTISRDNSKNTLYLQMNSLRAEDTAVYYCARGHHSGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 799 - protein, 217 aa, Artificial Sequence; identical to SEQ ID NO: 436
  TPP-18436_18206-gl17-hIgG1Lambda_LC_PRT

SEQ ID NO: 800 - DNA, 1353 bp, Artificial Sequence
  TPP-18436_18206-gl17-hIgG1Lambda_HC_DNA
gaagttcagctgctggaatctggcggcggactggttcaacctggcggatctctgagactgagctgtgccgccagcggcttcacctttagccactatggcatgcactgggtccgacaggcccctggcaaaggacttgaatgggtgtccgccatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggc

SEQ ID NO: 801 - DNA, 651 bp, Artificial Sequence; identical to SEQ ID NO: 701
  TPP-18436_18206-gl17-hIgG1Lambda_LC_DNA

SEQ ID NO: 802 - protein, 122 aa, Artificial Sequence; identical to SEQ ID NO: 599
  TPP-19571_18206-gl25-hIgG1Lambda_VH_PRT

SEQ ID NO: 803 - protein, 5 aa, Artificial Sequence
  TPP-19571_18206-gl25-hIgG1Lambda_HCDR1_PRT
SYGMH

SEQ ID NO: 804 - protein, 17 aa, Artificial Sequence
  TPP-19571_18206-gl25-hIgG1Lambda_HCDR2_PRT
AINWNGGSTGYADSVKG

SEQ ID NO: 805 - protein, 13 aa, Artificial Sequence
  TPP-19571_18206-gl25-hIgG1Lambda_HCDR3_PRT
GHHSGYDGRFFDY

SEQ ID NO: 806 - protein, 111 aa, Artificial Sequence; identical to SEQ ID NO: 423
  TPP-19571_18206-gl25-hIgG1Lambda_VL_PRT

SEQ ID NO: 807 - protein, 14 aa, Artificial Sequence
  TPP-19571_18206-gl25-hIgG1Lambda_LCDR1_PRT
TGSSSNIGAGYNVH

SEQ ID NO: 808 - protein, 7 aa, Artificial Sequence
  TPP-19571_18206-gl25-hIgG1Lambda_LCDR2_PRT
TNNRRPS

SEQ ID NO: 809 - protein, 11 aa, Artificial Sequence
  TPP-19571_18206-gl25-hIgG1Lambda_LCDR3_PRT
AAWDASLSGWV

SEQ ID NO: 810 - DNA, 366 bp, Artificial Sequence; identical to SEQ ID NO: 607
  TPP-19571_18206-gl25-hIgG1Lambda_VH_DNA

SEQ ID NO: 811 - DNA, 15 bp, Artificial Sequence
  TPP-19571_18206-gl25-hIgG1Lambda_HCDR1_DNA
agctatggcatgcac

SEQ ID NO: 812 - DNA, 51 bp, Artificial Sequence; identical to SEQ ID NO: 609
  TPP-19571_18206-gl25-hIgG1Lambda_HCDR2_DNA

SEQ ID NO: 813 - DNA, 39 bp, Artificial Sequence; identical to SEQ ID NO: 430
  TPP-19571_18206-gl25-hIgG1Lambda_HCDR3_DNA

SEQ ID NO: 814 - DNA, 333 bp, Artificial Sequence; identical to SEQ ID NO: 431
  TPP-19571_18206-gl25-hIgG1Lambda_VL_DNA

SEQ ID NO: 815 - DNA, 42 bp, Artificial Sequence; identical to SEQ ID NO: 432
  TPP-19571_18206-gl25-hIgG1Lambda_LCDR1_DNA

SEQ ID NO: 816 - DNA, 21 bp, Artificial Sequence
  TPP-19571_18206-gl25-hIgG1Lambda_LCDR2_DNA
accaacaacagacggcccagc

SEQ ID NO: 817 - DNA, 33 bp, Artificial Sequence; identical to SEQ ID NO: 434
  TPP-19571_18206-gl25-hIgG1Lambda_LCDR3_DNA

SEQ ID NO: 818 - protein, 451 aa, Artificial Sequence; identical to SEQ ID NO: 615
  TPP-19571_18206-gl25-hIgG1Lambda_HC_PRT

SEQ ID NO: 819 - protein, 217 aa, Artificial Sequence; identical to SEQ ID NO: 436
  TPP-19571_18206-gl25-hIgG1Lambda_LC_PRT

SEQ ID NO: 820 - DNA, 1353 bp, Artificial Sequence
  TPP-19571_18206-gl25-hIgG1Lambda_HC_DNA
gaagttcagctgctggaatctggcggcggactggttcaacctggcggatctctgagactgagctgtgccgccagcggcttcacctttagcagctatggcatgcactgggtccgacaggcccctggcaaaggacttgaatgggtgtccgccatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggc

SEQ ID NO: 821 - DNA, 651 bp, Artificial Sequence; identical to SEQ ID NO: 701
  TPP-19571_18206-gl25-hIgG1Lambda_LC_DNA

SEQ ID NO: 822 - DNA, 1353 bp, Artificial Sequence; identical to SEQ ID NO: 820
  TPP-21360_18206-gl25-gl13-hIgG1Lambda_HC_DNA

SEQ ID NO: 823 - DNA, 651 bp, Artificial Sequence; identical to SEQ ID NO: 679
  TPP-21360_18206-gl25-gl13-hIgG1Lambda_LC_DNA

SEQ ID NO: 824 - DNA, 1356 bp, Artificial Sequence; identical to SEQ ID NO: 698
  TPP-23411_21360-hIgG1lambda_HC_DNA

SEQ ID NO: 825 - DNA, 651 bp, Artificial Sequence; identical to SEQ ID NO: 679
  TPP-23411_21360-hIgG1lambda_LC_DNA

SEQ ID NO: 826 - protein, 122 aa, Artificial Sequence; identical to SEQ ID NO: 599
  TPP-27477_18206-gl10-gl25-hIgG1Lambda_VH_PRT

SEQ ID NO: 827 - protein, 5 aa, Artificial Sequence
  TPP-27477_18206-gl10-gl25-hIgG1Lambda_HCDR1_PRT
SYGMH

SEQ ID NO: 828 - protein, 17 aa, Artificial Sequence
  TPP-27477_18206-gl10-gl25-hIgG1Lambda_HCDR2_PRT
AINWNGGSTGYADSVKG

SEQ ID NO: 829 - protein, 13 aa, Artificial Sequence
  TPP-27477_18206-gl10-gl25-hIgG1Lambda_HCDR3_PRT
GHHSGYDGRFFDY

SEQ ID NO: 830 - protein, 111 aa, Artificial Sequence; identical to SEQ ID NO: 706
  TPP-27477_18206-gl10-gl25-hIgG1Lambda_VL_PRT

SEQ ID NO: 831 - protein, 14 aa, Artificial Sequence
  TPP-27477_18206-gl10-gl25-hIgG1Lambda_LCDR1_PRT
TGSSSNIGAGYNVH

SEQ ID NO: 832 - protein, 7 aa, Artificial Sequence
  TPP-27477_18206-gl10-gl25-hIgG1Lambda_LCDR2_PRT
TNNRRPS

SEQ ID NO: 833 - protein, 11 aa, Artificial Sequence
  TPP-27477_18206-gl10-gl25-hIgG1Lambda_LCDR3_PRT
AAWDASLSGWV

SEQ ID NO: 834 - DNA, 366 bp, Artificial Sequence; identical to SEQ ID NO: 607
  TPP-27477_18206-gl10-gl25-hIgG1Lambda_VH_DNA

SEQ ID NO: 835 - DNA, 15 bp, Artificial Sequence
  TPP-27477_18206-gl10-gl25-hIgG1Lambda_HCDR1_DNA
agctatggcatgcac

SEQ ID NO: 836 - DNA, 51 bp, Artificial Sequence; identical to SEQ ID NO: 609
  TPP-27477_18206-gl10-gl25-hIgG1Lambda_HCDR2_DNA

SEQ ID NO: 837 - DNA, 39 bp, Artificial Sequence; identical to SEQ ID NO: 430
  TPP-27477_18206-gl10-gl25-hIgG1Lambda_HCDR3_DNA

SEQ ID NO: 838 - DNA, 333 bp, Artificial Sequence; identical to SEQ ID NO: 714
  TPP-27477_18206-gl10-gl25-hIgG1Lambda_VL_DNA

SEQ ID NO: 839 - DNA, 42 bp, Artificial Sequence; identical to SEQ ID NO: 432
  TPP-27477_18206-gl10-gl25-hIgG1Lambda_LCDR1_DNA

SEQ ID NO: 840 - DNA, 21 bp, Artificial Sequence
  TPP-27477_18206-gl10-gl25-hIgG1Lambda_LCDR2_DNA
accaacaacagacggcccagc

SEQ ID NO: 841 - DNA, 33 bp, Artificial Sequence; identical to SEQ ID NO: 434
  TPP-27477_18206-gl10-gl25-hIgG1Lambda_LCDR3_DNA

SEQ ID NO: 842 - protein, 451 aa, Artificial Sequence; identical to SEQ ID NO: 615
  TPP-27477_18206-gl10-gl25-hIgG1Lambda_HC_PRT

SEQ ID NO: 843 - protein, 217 aa, Artificial Sequence; identical to SEQ ID NO: 719
  TPP-27477_18206-gl10-gl25-hIgG1Lambda_LC_PRT

SEQ ID NO: 844 - DNA, 1353 bp, Artificial Sequence; identical to SEQ ID NO: 820
  TPP-27477_18206-gl10-gl25-hIgG1Lambda_HC_DNA

SEQ ID NO: 845 - DNA, 651 bp, Artificial Sequence; identical to SEQ ID NO: 721
  TPP-27477_18206-gl10-gl25-hIgG1Lambda_LC_DNA

SEQ ID NO: 846 - protein, 122 aa, Artificial Sequence; identical to SEQ ID NO: 599
  TPP-27478_18206-gl11-gl25-hIgG1Lambda_VH_PRT

SEQ ID NO: 847 - protein, 5 aa, Artificial Sequence
  TPP-27478_18206-gl11-gl25-hIgG1Lambda_HCDR1_PRT
SYGMH

SEQ ID NO: 848 - protein, 17 aa, Artificial Sequence
  TPP-27478_18206-gl11-gl25-hIgG1Lambda_HCDR2_PRT
AINWNGGSTGYADSVKG

SEQ ID NO: 849 - protein, 13 aa, Artificial Sequence
  TPP-27478_18206-gl11-gl25-hIgG1Lambda_HCDR3_PRT
GHHSGYDGRFFDY

SEQ ID NO: 850 - protein, 111 aa, Artificial Sequence; identical to SEQ ID NO: 684
  TPP-27478_18206-gl11-gl25-hIgG1Lambda_VL_PRT

SEQ ID NO: 851 - protein, 14 aa, Artificial Sequence
  TPP-27478_18206-gl11-gl25-hIgG1Lambda_LCDR1_PRT
TGSSSNIGAGYNVH

SEQ ID NO: 852 - protein, 7 aa, Artificial Sequence
  TPP-27478_18206-gl11-gl25-hIgG1Lambda_LCDR2_PRT
TNNRRPS

SEQ ID NO: 853 - protein, 11 aa, Artificial Sequence
  TPP-27478_18206-gl11-gl25-hIgG1Lambda_LCDR3_PRT
AAWDASLSGWV

SEQ ID NO: 854 - DNA, 366 bp, Artificial Sequence; identical to SEQ ID NO: 607
  TPP-27478_18206-gl11-gl25-hIgG1Lambda_VH_DNA

SEQ ID NO: 855 - DNA, 15 bp, Artificial Sequence
  TPP-27478_18206-gl11-gl25-hIgG1Lambda_HCDR1_DNA
agctatggcatgcac

SEQ ID NO: 856 - DNA, 51 bp, Artificial Sequence; identical to SEQ ID NO: 609
  TPP-27478_18206-gl11-gl25-hIgG1Lambda_HCDR2_DNA

SEQ ID NO: 857 - DNA, 39 bp, Artificial Sequence; identical to SEQ ID NO: 430
  TPP-27478_18206-gl11-gl25-hIgG1Lambda_HCDR3_DNA

SEQ ID NO: 858 - DNA, 333 bp, Artificial Sequence; identical to SEQ ID NO: 692
  TPP-27478_18206-gl11-gl25-hIgG1Lambda_VL_DNA

SEQ ID NO: 859 - DNA, 42 bp, Artificial Sequence; identical to SEQ ID NO: 486
  TPP-27478_18206-gl11-gl25-hIgG1Lambda_LCDR1_DNA

SEQ ID NO: 860 - DNA, 21 bp, Artificial Sequence
  TPP-27478_18206-gl11-gl25-hIgG1Lambda_LCDR2_DNA
accaacaacagacggcccagc

SEQ ID NO: 861 - DNA, 33 bp, Artificial Sequence; identical to SEQ ID NO: 434
  TPP-27478_18206-gl11-gl25-hIgG1Lambda_LCDR3_DNA

SEQ ID NO: 862 - protein, 451 aa, Artificial Sequence; identical to SEQ ID NO: 615
  TPP-27478_18206-gl11-gl25-hIgG1Lambda_HC_PRT

SEQ ID NO: 863 - protein, 217 aa, Artificial Sequence; identical to SEQ ID NO: 697
  TPP-27478_18206-gl11-gl25-hIgG1Lambda_LC_PRT

SEQ ID NO: 864 - DNA, 1353 bp, Artificial Sequence; identical to SEQ ID NO: 820
  TPP-27478_18206-gl11-gl25-hIgG1Lambda_HC_DNA

SEQ ID NO: 865 - DNA, 651 bp, Artificial Sequence; identical to SEQ ID NO: 699
  TPP-27478_18206-gl11-gl25-hIgG1Lambda_LC_DNA

SEQ ID NO: 866 - protein, 122 aa, Artificial Sequence; identical to SEQ ID NO: 660
  TPP-27479_18206-gl13-gl14-hIgG1Lambda_VH_PRT

SEQ ID NO: 867 - protein, 5 aa, Artificial Sequence
  TPP-27479_18206-gl13-gl14-hIgG1Lambda_HCDR1_PRT
SYGMH

SEQ ID NO: 868 - protein, 17 aa, Artificial Sequence
  TPP-27479_18206-gl13-gl14-hIgG1Lambda_HCDR2_PRT
GINWNGGSTGYADSVKG

SEQ ID NO: 869 - protein, 13 aa, Artificial Sequence
  TPP-27479_18206-gl13-gl14-hIgG1Lambda_HCDR3_PRT
GHHSGYDGRFFDY

SEQ ID NO: 870 - protein, 111 aa, Artificial Sequence; identical to SEQ ID NO: 477
  TPP-27479_18206-gl13-gl14-hIgG1Lambda_VL_PRT

SEQ ID NO: 871 - protein, 14 aa, Artificial Sequence
  TPP-27479_18206-gl13-gl14-hIgG1Lambda_LCDR1_PRT
TGSSSNIGAGYNVH

SEQ ID NO: 872 - protein, 7 aa, Artificial Sequence
  TPP-27479_18206-gl13-gl14-hIgG1Lambda_LCDR2_PRT
TNNRRPS

SEQ ID NO: 873 - protein, 11 aa, Artificial Sequence
  TPP-27479_18206-gl13-gl14-hIgG1Lambda_LCDR3_PRT
AAWDASLSGWV

SEQ ID NO: 874 - DNA, 366 bp, Artificial Sequence; identical to SEQ ID NO: 668
  TPP-27479_18206-gl13-gl14-hIgG1Lambda_VH_DNA

SEQ ID NO: 875 - DNA, 15 bp, Artificial Sequence
  TPP-27479_18206-gl13-gl14-hIgG1Lambda_HCDR1_DNA
agctatggcatgcac

SEQ ID NO: 876 - DNA, 51 bp, Artificial Sequence; identical to SEQ ID NO: 429
  TPP-27479_18206-gl13-gl14-hIgG1Lambda_HCDR2_DNA

SEQ ID NO: 877 - DNA, 39 bp, Artificial Sequence; identical to SEQ ID NO: 430
  TPP-27479_18206-gl13-gl14-hIgG1Lambda_HCDR3_DNA

SEQ ID NO: 878 - DNA, 333 bp, Artificial Sequence; identical to SEQ ID NO: 485
  TPP-27479_18206-gl13-gl14-hIgG1Lambda_VL_DNA

SEQ ID NO: 879 - DNA, 42 bp, Artificial Sequence; identical to SEQ ID NO: 486
  TPP-27479_18206-gl13-gl14-hIgG1Lambda_LCDR1_DNA

SEQ ID NO: 880 - DNA, 21 bp, Artificial Sequence
  TPP-27479_18206-gl13-gl14-hIgG1Lambda_LCDR2_DNA
accaacaacagacggcccagc

SEQ ID NO: 881 - DNA, 33 bp, Artificial Sequence; identical to SEQ ID NO: 434
  TPP-27479_18206-gl13-gl14-hIgG1Lambda_LCDR3_DNA

SEQ ID NO: 882 - protein, 451 aa, Artificial Sequence; identical to SEQ ID NO: 778
  TPP-27479_18206-gl13-gl14-hIgG1Lambda_HC_PRT

SEQ ID NO: 883 - protein, 217 aa, Artificial Sequence; identical to SEQ ID NO: 490
  TPP-27479_18206-gl13-gl14-hIgG1Lambda_LC_PRT

SEQ ID NO: 884 - DNA, 1353 bp, Artificial Sequence; identical to SEQ ID NO: 780
  TPP-27479_18206-gl13-gl14-hIgG1Lambda_HC_DNA

SEQ ID NO: 885 - DNA, 651 bp, Artificial Sequence; identical to SEQ ID NO: 679
  TPP-27479_18206-gl13-gl14-hIgG1Lambda_LC_DNA

SEQ ID NO: 886 - protein, 122 aa, Artificial Sequence; identical to SEQ ID NO: 782
  TPP-27480_18206-gl13-gl20-hIgG1Lambda_VH_PRT

SEQ ID NO: 887 - protein, 5 aa, Artificial Sequence
  TPP-27480_18206-gl13-gl20-hIgG1Lambda_HCDR1_PRT
HYGMH

SEQ ID NO: 888 - protein, 17 aa, Artificial Sequence
  TPP-27480_18206-gl13-gl20-hIgG1Lambda_HCDR2_PRT
AINWNGGSTGYADSVKG

SEQ ID NO: 889 - protein, 13 aa, Artificial Sequence
  TPP-27480_18206-gl13-gl20-hIgG1Lambda_HCDR3_PRT
GHHSGYDGRFFDY

SEQ ID NO: 890 - protein, 111 aa, Artificial Sequence; identical to SEQ ID NO: 477
  TPP-27480_18206-gl13-gl20-hIgG1Lambda_VL_PRT

SEQ ID NO: 891 - protein, 14 aa, Artificial Sequence
  TPP-27480_18206-gl13-gl20-hIgG1Lambda_LCDR1_PRT
TGSSSNIGAGYNVH

SEQ ID NO: 892 - protein, 7 aa, Artificial Sequence
  TPP-27480_18206-gl13-gl20-hIgG1Lambda_LCDR2_PRT
TNNRRPS

SEQ ID NO: 893 - protein, 11 aa, Artificial Sequence
  TPP-27480_18206-gl13-gl20-hIgG1Lambda_LCDR3_PRT
AAWDASLSGWV

SEQ ID NO: 894 - DNA, 366 bp, Artificial Sequence; identical to SEQ ID NO: 790
  TPP-27480_18206-gl13-gl20-hIgG1Lambda_VH_DNA

SEQ ID NO: 895 - DNA, 15 bp, Artificial Sequence
  TPP-27480_18206-gl13-gl20-hIgG1Lambda_HCDR1_DNA
cactatggcatgcac

SEQ ID NO: 896 - DNA, 51 bp, Artificial Sequence; identical to SEQ ID NO: 609
  TPP-27480_18206-gl13-gl20-hIgG1Lambda_HCDR2_DNA

SEQ ID NO: 897 - DNA, 39 bp, Artificial Sequence; identical to SEQ ID NO: 430
  TPP-27480_18206-gl13-gl20-hIgG1Lambda_HCDR3_DNA

SEQ ID NO: 898 - DNA, 333 bp, Artificial Sequence; identical to SEQ ID NO: 485
  TPP-27480_18206-gl13-gl20-hIgG1Lambda_VL_DNA

SEQ ID NO: 899 - DNA, 42 bp, Artificial Sequence; identical to SEQ ID NO: 486
  TPP-27480_18206-gl13-gl20-hIgG1Lambda_LCDR1_DNA

SEQ ID NO: 900 - DNA, 21 bp, Artificial Sequence
  TPP-27480_18206-gl13-gl20-hIgG1Lambda_LCDR2_DNA
accaacaacagacggcccagc

SEQ ID NO: 901 - DNA, 33 bp, Artificial Sequence; identical to SEQ ID NO: 434
  TPP-27480_18206-gl13-gl20-hIgG1Lambda_LCDR3_DNA

SEQ ID NO: 902 - protein, 451 aa, Artificial Sequence; identical to SEQ ID NO: 798
  TPP-27480_18206-gl13-gl20-hIgG1Lambda_HC_PRT

SEQ ID NO: 903 - protein, 217 aa, Artificial Sequence; identical to SEQ ID NO: 490
  TPP-27480_18206-gl13-gl20-hIgG1Lambda_LC_PRT

SEQ ID NO: 904 - DNA, 1353 bp, Artificial Sequence; identical to SEQ ID NO: 800
  TPP-27480_18206-gl13-gl20-hIgG1Lambda_HC_DNA

SEQ ID NO: 905 - DNA, 651 bp, Artificial Sequence; identical to SEQ ID NO: 679
  TPP-27480_18206-gl13-gl20-hIgG1Lambda_LC_DNA

SEQ ID NO: 906 - protein, 122 aa, Artificial Sequence; identical to SEQ ID NO: 419
  TPP-29367_18206-hIgG1wtLambda_VH_PRT

SEQ ID NO: 907 - protein, 5 aa, Artificial Sequence
  TPP-29367_18206-hIgG1wtLambda_HCDR1_PRT
HYGMH

SEQ ID NO: 908 - protein, 17 aa, Artificial Sequence
  TPP-29367_18206-hIgG1wtLambda_HCDR2_PRT
GINWNGGSTGYADSVKG

SEQ ID NO: 909 - protein, 13 aa, Artificial Sequence
  TPP-29367_18206-hIgG1wtLambda_HCDR3_PRT
GHHSGYDGRFFDY

SEQ ID NO: 910 - protein, 111 aa, Artificial Sequence; identical to SEQ ID NO: 423
  TPP-29367_18206-hIgG1wtLambda_VL_PRT

SEQ ID NO: 911 - protein, 14 aa, Artificial Sequence
  TPP-29367_18206-hIgG1wtLambda_LCDR1_PRT
TGSSSNIGAGYNVH

SEQ ID NO: 912 - protein, 7 aa, Artificial Sequence
  TPP-29367_18206-hIgG1wtLambda_LCDR2_PRT
TNNRRPS

SEQ ID NO: 913 - protein, 11 aa, Artificial Sequence
  TPP-29367_18206-hIgG1wtLambda_LCDR3_PRT
AAWDASLSGWV

SEQ ID NO: 914 - DNA, 366 bp, Artificial Sequence; identical to SEQ ID NO: 427
  TPP-29367_18206-hIgG1wtLambda_VH_DNA

SEQ ID NO: 915 - DNA, 15 bp, Artificial Sequence
  TPP-29367_18206-hIgG1wtLambda_HCDR1_DNA
cactatggcatgcac

SEQ ID NO: 916 - DNA, 51 bp, Artificial Sequence; identical to SEQ ID NO: 429
  TPP-29367_18206-hIgG1wtLambda_HCDR2_DNA

SEQ ID NO: 917 - DNA, 39 bp, Artificial Sequence; identical to SEQ ID NO: 430
  TPP-29367_18206-hIgG1wtLambda_HCDR3_DNA

SEQ ID NO: 918 - DNA, 333 bp, Artificial Sequence; identical to SEQ ID NO: 431
  TPP-29367_18206-hIgG1wtLambda_VL_DNA

SEQ ID NO: 919 - DNA, 42 bp, Artificial Sequence; identical to SEQ ID NO: 432
  TPP-29367_18206-hIgG1wtLambda_LCDR1_DNA

SEQ ID NO: 920 - DNA, 21 bp, Artificial Sequence
  TPP-29367_18206-hIgG1wtLambda_LCDR2_DNA
accaacaacagacggcccagc

SEQ ID NO: 921 - DNA, 33 bp, Artificial Sequence; identical to SEQ ID NO: 434
  TPP-29367_18206-hIgG1wtLambda_LCDR3_DNA

SEQ ID NO: 922 - protein, 452 aa, Artificial Sequence
  TPP-29367_18206-hIgG1wtLambda_HC_PRT
EVQLLESGGGLVQPGGSLRLSCAASGFTFSHYGMHWVRQAPGKGLEWVSGINWNGGSTGYADSVKGRFTISRDNSKNTLYLQMNSLRAEDTAVYYCARGHHSGYDGRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 923 - protein, 217 aa, Artificial Sequence; identical to SEQ ID NO: 436
  TPP-29367_18206-hIgG1wtLambda_LC_PRT

SEQ ID NO: 924 - DNA, 1356 bp, Artificial Sequence
  TPP-29367_18206-hIgG1wtLambda_HC_DNA
gaagttcagctgctggaatctggcggcggactggttcaacctggcggatctctgagactgagctgtgccgccagcggcttcacctttagccactatggcatgcactgggtccgacaggcccctggcaaaggacttgaatgggtgtccggcatcaactggaatggcggctctacaggctacgccgactctgtgaagggcagattcaccatcagccgggacaacagcaagaacaccctgtacctgcagatgaactccctgagagccgaggacaccgccgtgtactattgtgccagaggccaccacagcggctacgacggcagattctttgactattggggccagggcaccctggtcacagtttcttcagccagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccctggcaag

SEQ ID NO: 925 - DNA, 651 bp, Artificial Sequence; identical to SEQ ID NO: 701
  TPP-29367_18206-hIgG1wtLambda_LC_DNA

SEQ ID NO: 926 - protein, 122 aa, Artificial Sequence; identical to SEQ ID NO: 419
  TPP-29368_18432-hIgG1wtLambda_VH_PRT

SEQ ID NO: 927 - protein, 5 aa, Artificial Sequence
  TPP-29368_18432-hIgG1wtLambda_HCDR1_PRT
HYGMH

SEQ ID NO: 928 - protein, 17 aa, Artificial Sequence
  TPP-29368_18432-hIgG1wtLambda_HCDR2_PRT
GINWNGGSTGYADSVKG

SEQ ID NO: 929 - protein, 13 aa, Artificial Sequence
  TPP-29368_18432-hIgG1wtLambda_HCDR3_PRT
GHHSGYDGRFFDY

SEQ ID NO: 930 - protein, 111 aa, Artificial Sequence; identical to SEQ ID NO: 477
  TPP-29368_18432-hIgG1wtLambda_VL_PRT

SEQ ID NO: 931 - protein, 14 aa, Artificial Sequence
  TPP-29368_18432-hIgG1wtLambda_LCDR1_PRT
TGSSSNIGAGYNVH

SEQ ID NO: 932 - protein, 7 aa, Artificial Sequence
  TPP-29368_18432-hIgG1wtLambda_LCDR2_PRT
TNNRRPS

SEQ ID NO: 933 - protein, 11 aa, Artificial Sequence
  TPP-29368_18432-hIgG1wtLambda_LCDR3_PRT
AAWDASLSGWV

SEQ ID NO: 934 - DNA, 366 bp, Artificial Sequence; identical to SEQ ID NO: 427
  TPP-29368_18432-hIgG1wtLambda_VH_DNA

SEQ ID NO: 935 - DNA, 15 bp, Artificial Sequence
  TPP-29368_18432-hIgG1wtLambda_HCDR1_DNA
cactatggcatgcac

SEQ ID NO: 936 - DNA, 51 bp, Artificial Sequence; identical to SEQ ID NO: 429
  TPP-29368_18432-hIgG1wtLambda_HCDR2_DNA

SEQ ID NO: 937 - DNA, 39 bp, Artificial Sequence; identical to SEQ ID NO: 430
  TPP-29368_18432-hIgG1wtLambda_HCDR3_DNA

SEQ ID NO: 938 - DNA, 333 bp, Artificial Sequence; identical to SEQ ID NO: 485
  TPP-29368_18432-hIgG1wtLambda_VL_DNA

SEQ ID NO: 939 - DNA, 42 bp, Artificial Sequence; identical to SEQ ID NO: 486
  TPP-29368_18432-hIgG1wtLambda_LCDR1_DNA

SEQ ID NO: 940 - DNA, 21 bp, Artificial Sequence
  TPP-29368_18432-hIgG1wtLambda_LCDR2_DNA
accaacaacagacggcccagc

SEQ ID NO: 941 - DNA, 33 bp, Artificial Sequence; identical to SEQ ID NO: 434
  TPP-29368_18432-hIgG1wtLambda_LCDR3_DNA

SEQ ID NO: 942 - protein, 452 aa, Artificial Sequence; identical to SEQ ID NO: 922
  TPP-29368_18432-hIgG1wtLambda_HC_PRT

SEQ ID NO: 943 - protein, 217 aa, Artificial Sequence; identical to SEQ ID NO: 490
  TPP-29368_18432-hIgG1wtLambda_LC_PRT

SEQ ID NO: 944 - DNA, 1356 bp, Artificial Sequence; identical to SEQ ID NO: 924
  TPP-29368_18432-hIgG1wtLambda_HC_DNA

SEQ ID NO: 945 - DNA, 651 bp, Artificial Sequence; identical to SEQ ID NO: 679
  TPP-29368_18432-hIgG1wtLambda_LC_DNA

SEQ ID NO: 946 - protein, 122 aa, Artificial Sequence; identical to SEQ ID NO: 599
  TPP-29369_19571-hIgG1wtlambda_VH_PRT

SEQ ID NO: 947 - protein, 5 aa, Artificial Sequence
  TPP-29369_19571-hIgG1wtlambda_HCDR1_PRT
SYGMH

SEQ ID NO: 948 - protein, 17 aa, Artificial Sequence
  TPP-29369_19571-hIgG1wtlambda_HCDR2_PRT
AINWNGGSTGYADSVKG

SEQ ID NO: 949 - protein, 13 aa, Artificial Sequence
  TPP-29369_19571-hIgG1wtlambda_HCDR3_PRT
GHHSGYDGRFFDY

SEQ ID NO: 950 - protein, 111 aa, Artificial Sequence; identical to SEQ ID NO: 423
  TPP-29369_19571-hIgG1wtlambda_VL_PRT

SEQ ID NO: 951 - protein, 14 aa, Artificial Sequence
  TPP-29369_19571-hIgG1wtlambda_LCDR1_PRT
TGSSSNIGAGYNVH

SEQ ID NO: 952 - protein, 7 aa, Artificial Sequence
  TPP-29369_19571-hIgG1wtlambda_LCDR2_PRT
TNNRRPS

SEQ ID NO: 953 - protein, 11 aa, Artificial Sequence
  TPP-29369_19571-hIgG1wtlambda_LCDR3_PRT
AAWDASLSGWV

SEQ ID NO: 954 - DNA, 366 bp, Artificial Sequence; identical to SEQ ID NO: 607
  TPP-29369_19571-hIgG1wtlambda_VH_DNA

SEQ ID NO: 955 - DNA, 15 bp, Artificial Sequence
  TPP-29369_19571-hIgG1wtlambda_HCDR1_DNA
agctatggcatgcac

SEQ ID NO: 956 - DNA, 51 bp, Artificial Sequence; identical to SEQ ID NO: 609
  TPP-29369_19571-hIgG1wtlambda_HCDR2_DNA

SEQ ID NO: 957 - DNA, 39 bp, Artificial Sequence; identical to SEQ ID NO: 430
  TPP-29369_19571-hIgG1wtlambda_HCDR3_DNA

SEQ ID NO: 958 - DNA, 333 bp, Artificial Sequence; identical to SEQ ID NO: 431
  TPP-29369_19571-hIgG1wtlambda_VL_DNA

SEQ ID NO: 959 - DNA, 42 bp, Artificial Sequence; identical to SEQ ID NO: 432
  TPP-29369_19571-hIgG1wtlambda_LCDR1_DNA

SEQ ID NO: 960 - DNA, 21 bp, Artificial Sequence
  TPP-29369_19571-hIgG1wtlambda_LCDR2_DNA
accaacaacagacggcccagc

SEQ ID NO: 961 - DNA, 33 bp, Artificial Sequence; identical to SEQ ID NO: 434
  TPP-29369_19571-hIgG1wtlambda_LCDR3_DNA

SEQ ID NO: 962 - protein, 452 aa, Artificial Sequence; identical to SEQ ID NO: 633
  TPP-29369_19571-hIgG1wtlambda_HC_PRT

SEQ ID NO: 963 - protein, 217 aa, Artificial Sequence; identical to SEQ ID NO: 436
  TPP-29369_19571-hIgG1wtlambda_LC_PRT

SEQ ID NO: 964 - DNA, 1356 bp, Artificial Sequence; identical to SEQ ID NO: 698
  TPP-29369_19571-hIgG1wtlambda_HC_DNA

SEQ ID NO: 965 - DNA, 651 bp, Artificial Sequence; identical to SEQ ID NO: 701
  TPP-29369_19571-hIgG1wtlambda_LC_DNA

SEQ ID NO: 966 - protein, 26 aa, Artificial Sequence
  Cyno CCR8 TRD peptide for epitope characterization
  MISC_FEATURE (26)..(26): Biotinylated
CMDYTLDPSMTTMTDYYYPDSLSSPK

SEQ ID NO: 967 - protein, 26 aa, Artificial Sequence
  Sulfated cyno CCR8 TRD peptide for epitope characterization
  MISC_FEATURE (4)..(4): Sulfated
  MISC_FEATURE (16)..(16): Sulfated
  MISC_FEATURE (18)..(18): Sulfated
  MISC_FEATURE (26)..(26): Biotinylated
CMDYTLDPSMTTMTDYYYPDSLSSPK

SEQ ID NO: 968 - protein, 26 aa, Artificial Sequence
  Human CCR8 TRD peptide for epitope characterization
  MISC_FEATURE (26)..(26): Biotinylated
CMDYTLDLSVTTVTDYYYPDIFSSPK

SEQ ID NO: 969 - protein, 26 aa, Artificial Sequence
  Sulfated human CCR8 TRD peptide for epitope characterization
  MISC_FEATURE (4)..(4): Sulfated
  MISC_FEATURE (16)..(16): Sulfated
  MISC_FEATURE (18)..(18): Sulfated
  MISC_FEATURE (26)..(26): Biotinylated
CMDYTLDLSVTTVTDYYYPDIFSSPK

SEQ ID NO: 970 - protein, 37 aa, Artificial Sequence
  Cyno CCR8 N term peptide for epitope characterization
  MISC_FEATURE (37)..(37): Biotinylated
CMDYTLDPSMTTMTDYYYPDSLSSPSDGELIQRNDKK

SEQ ID NO: 971 - protein, 37 aa, Artificial Sequence; identical to SEQ ID NO: 970
  Sulfated cyno CCR8 N term peptide for epitope characterization
  MISC_FEATURE (4)..(4): Sulfated
  MISC_FEATURE (16)..(16): Sulfated
  MISC_FEATURE (18)..(18): Sulfated
  MISC_FEATURE (37)..(37): Biotinylated

SEQ ID NO: 972 - protein, 37 aa, Artificial Sequence
  Human CCR8 N term peptide for epitope characterization
  MISC_FEATURE (37)..(37): Biotinylated
CMDYTLDLSVTTVTDYYYPDIFSSPSDAELIQTNGKK

SEQ ID NO: 973 - protein, 37 aa, Artificial Sequence; identical to SEQ ID NO: 972
  Sulfated human CCR8 N term peptide for epitope characterization
  MISC_FEATURE (4)..(4): Sulfated
  MISC_FEATURE (16)..(16): Sulfated
  MISC_FEATURE (18)..(18): Sulfated
  MISC_FEATURE (37)..(37): Biotinylated

We claim:
1. An isolated anti-CCR8 antibody or antigen-binding fragment thereof comprising six CDR sequences wherein each CDR has an amino acid sequence set forth in one of (a) to (r):
  a. SEQ ID NO:420, SEQ ID NO:421, SEQ ID NO:422, SEQ ID NO:424, SEQ ID NO:425 and SEQ ID NO:426,
  b. SEQ ID NO:600, SEQ ID NO:601, SEQ ID NO:602, SEQ ID NO:604, SEQ ID NO:605 and SEQ ID NO:606,
  c. SEQ ID NO:618, SEQ ID NO:619, SEQ ID NO:620, SEQ ID NO:622, SEQ ID NO:623 and SEQ ID NO:624,
  d. SEQ ID NO:661, SEQ ID NO:662, SEQ ID NO:663, SEQ ID NO:665, SEQ ID NO:666 and SEQ ID NO:667,
  e. SEQ ID NO:681, SEQ ID NO:682, SEQ ID NO:683, SEQ ID NO:685, SEQ ID NO:686 and SEQ ID NO:687,
  f SEQ ID NO:703, SEQ ID NO:704, SEQ ID NO:705, SEQ ID NO:707, SEQ ID NO:708 and SEQ ID NO:709,
  g. SEQ ID NO:723, SEQ ID NO:724, SEQ ID NO:725, SEQ ID NO:727, SEQ ID NO:728 and SEQ ID NO:729,
  h. SEQ ID NO:743, SEQ ID NO:744, SEQ ID NO:745, SEQ ID NO:747, SEQ ID NO:748 and SEQ ID NO:749,
  i. SEQ ID NO:763, SEQ ID NO:764, SEQ ID NO:765, SEQ ID NO:767, SEQ ID NO:768 and SEQ ID NO:769,
  j. SEQ ID NO:783, SEQ ID NO:784, SEQ ID NO:785, SEQ ID NO:787, SEQ ID NO:788 and SEQ ID NO:789,
  k. SEQ ID NO:803, SEQ ID NO:804, SEQ ID NO:805, SEQ ID NO:807, SEQ ID NO:808 and SEQ ID NO:809,
  l. SEQ ID NO:827, SEQ ID NO: 828, SEQ ID NO: 829, SEQ ID NO: 831, SEQ ID NO:832 and SEQ ID NO:833,
  m. SEQ ID NO:847, SEQ ID NO: 848, SEQ ID NO: 849, SEQ ID NO: 851, SEQ ID NO:852 and SEQ ID NO:853,
  n. SEQ ID NO:867, SEQ ID NO: 868, SEQ ID NO: 869, SEQ ID NO: 871, SEQ ID NO:872 and SEQ ID NO:873,
  o. SEQ ID NO:887, SEQ ID NO: 888, SEQ ID NO: 889, SEQ ID NO: 891, SEQ ID NO:892 and SEQ ID NO:893,
  p. SEQ ID NO:907, SEQ ID NO: 908, SEQ ID NO: 909, SEQ ID NO: 911, SEQ ID NO:912 and SEQ ID NO:913,
  q. SEQ ID NO:927, SEQ ID NO: 928, SEQ ID NO: 929, SEQ ID NO: 931, SEQ ID NO:932 and SEQ ID NO:933, and
  r. SEQ ID NO:947, SEQ ID NO: 948, SEQ ID NO: 949, SEQ ID NO: 951, SEQ ID NO:952 and SEQ ID NO:953.
2. The isolated anti-CCR8 antibody or antigen-binding fragment thereof of claim 1 further comprising a variable heavy chain sequence and/or a variable light chain sequence having an amino acid sequence set forth in one of (a) to (r)

a. a variable heavy chain sequence according to SEQ ID NO:419 and/or a variable light chain sequence according to SEQ ID NO:423,
b. a variable heavy chain sequence according to SEQ ID NO:599 and/or a variable light chain sequence according to SEQ ID NO:603,
c. a variable heavy chain sequence according to SEQ ID NO:617 and/or a variable light chain sequence according to SEQ ID NO:621,
d. a variable heavy chain sequence according to SEQ ID NO:660 and/or a variable light chain sequence according to SEQ ID NO:664,
e. a variable heavy chain sequence according to SEQ ID NO:680 and/or a variable light chain sequence according to SEQ ID NO:684,
f. a variable heavy chain sequence according to SEQ ID NO:702 and/or a variable light chain sequence according to SEQ ID NO:706,
g. a variable heavy chain sequence according to SEQ ID NO:722 and/or a variable light chain sequence according to SEQ ID NO:726,
h. a variable heavy chain sequence according to SEQ ID NO:742 and/or a variable light chain sequence according to SEQ ID NO:746,
i. a variable heavy chain sequence according to SEQ ID NO:762 and/or a variable light chain sequence according to SEQ ID NO:766,
j. a variable heavy chain sequence according to SEQ ID NO:782 and/or a variable light chain sequence according to SEQ ID NO:786,
k. a variable heavy chain sequence according to SEQ ID NO:802 and/or a variable light chain sequence according to SEQ ID NO:806,
l. a variable heavy chain sequence according to SEQ ID NO:826 and/or a variable light chain sequence according to SEQ ID NO:830,
m. a variable heavy chain sequence according to SEQ ID NO:846 and/or a variable light chain sequence according to SEQ ID NO:850,
n. a variable heavy chain sequence according to SEQ ID NO:866 and/or a variable light chain sequence according to SEQ ID NO:870,
o. a variable heavy chain sequence according to SEQ ID NO:886 and/or a variable light chain sequence according to SEQ ID NO:890,
p. a variable heavy chain sequence according to SEQ ID NO:906 and/or a variable light chain sequence according to SEQ ID NO:910,
q. a variable heavy chain sequence according to SEQ ID NO:926 and/or a variable light chain sequence according to SEQ ID NO:930, or
r. a variable heavy chain sequence according to SEQ ID NO:946 and/or a variable light chain sequence according to SEQ ID NO:950.

3. The isolated anti-CCR8 antibody or antigen-binding fragment thereof of claim 1 further comprising a heavy chain sequence and/or a light chain sequence having an amino acid sequence set forth in one of (a) to (r):
   a. a heavy chain according to SEQ ID NO:435 and a light chain according to SEQ ID NO:436,
   b. a heavy chain according to SEQ ID NO:615 and a light chain according to SEQ ID NO:616,
   c. a heavy chain according to SEQ ID NO:633 and a light chain according to SEQ ID NO:634,
   d. a heavy chain according to SEQ ID NO:676 and a light chain according to SEQ ID NO:677,
   e. a heavy chain according to SEQ ID NO:696 and a light chain according to SEQ ID NO:697,
   f. a heavy chain according to SEQ ID NO:718 and a light chain according to SEQ ID NO:719,
   g. a heavy chain according to SEQ ID NO:738 and a light chain according to SEQ ID NO:739,
   h. a heavy chain according to SEQ ID NO:758 and a light chain according to SEQ ID NO:759,
   i. a heavy chain according to SEQ ID NO:778 and a light chain according to SEQ ID NO:779,
   j. a heavy chain according to SEQ ID NO:798 and a light chain according to SEQ ID NO:799,
   k. a heavy chain according to SEQ ID NO:818 and a light chain according to SEQ ID NO:819,
   l. a heavy chain according to SEQ ID NO:842 and a light chain according to SEQ ID NO:843,
   m. a heavy chain according to SEQ ID NO:862 and a light chain according to SEQ ID NO:863,
   n. a heavy chain according to SEQ ID NO:882 and a light chain according to SEQ ID NO:883,
   o. a heavy chain according to SEQ ID NO:902 and a light chain according to SEQ ID NO:903,
   p. a heavy chain according to SEQ ID NO:922 and a light chain according to SEQ ID NO:923,
   q. a heavy chain according to SEQ ID NO:942 and a light chain according to SEQ ID NO:943, and
   r. a heavy chain according to SEQ ID NO:962 and a light chain according to SEQ ID NO:963.

4. A polynucleotide encoding an antibody or antigen-binding fragment according to claim 1; wherein the antibody or antigen-binding fragment comprises six CDR sequences wherein each CDR has an amino acid sequence set forth in one of (a) to (r):
   a. SEQ ID NO:420, SEQ ID NO:421, SEQ ID NO:422, SEQ ID NO:424, SEQ ID NO:425 and SEQ ID NO:426,
   b. SEQ ID NO:600, SEQ ID NO:601, SEQ ID NO:602, SEQ ID NO:604, SEQ ID NO:605 and SEQ ID NO:606,
   c. SEQ ID NO:618, SEQ ID NO:619, SEQ ID NO:620, SEQ ID NO:622, SEQ ID NO:623 and SEQ ID NO:624,
   d. SEQ ID NO:661, SEQ ID NO:662, SEQ ID NO:663, SEQ ID NO:665, SEQ ID NO:666 and SEQ ID NO:667,
   e. SEQ ID NO:681, SEQ ID NO:682, SEQ ID NO:683, SEQ ID NO:685, SEQ ID NO:686 and SEQ ID NO:687,
   f. SEQ ID NO:703, SEQ ID NO:704, SEQ ID NO:705, SEQ ID NO:707, SEQ ID NO:708 and SEQ ID NO:709,
   g. SEQ ID NO:723, SEQ ID NO:724, SEQ ID NO:725, SEQ ID NO:727, SEQ ID NO:728 and SEQ ID NO:729,
   h. SEQ ID NO:743, SEQ ID NO:744, SEQ ID NO:745, SEQ ID NO:747, SEQ ID NO:748 and SEQ ID NO:749,
   i. SEQ ID NO:763, SEQ ID NO:764, SEQ ID NO:765, SEQ ID NO:767, SEQ ID NO:768 and SEQ ID NO:769,
   j. SEQ ID NO:783, SEQ ID NO:784, SEQ ID NO:785, SEQ ID NO:787, SEQ ID NO:788 and SEQ ID NO:789,
   k. SEQ ID NO:803, SEQ ID NO:804, SEQ ID NO:805, SEQ ID NO:807, SEQ ID NO:808 and SEQ ID NO:809, l. SEQ ID NO:827, SEQ ID NO: 828, SEQ ID NO: 829, SEQ ID NO: 831, SEQ ID NO:832 and SEQ ID NO:833, m. SEQ ID NO:847, SEQ ID NO: 848, SEQ ID NO: 849, SEQ ID NO: 851, SEQ ID NO:852 and SEQ ID NO:853, n. SEQ ID NO:867, SEQ ID NO: 868, SEQ ID NO: 869, SEQ ID NO: 871, SEQ ID NO:872 and SEQ ID NO:873, o. SEQ ID NO:887, SEQ ID NO: 888, SEQ ID NO: 889, SEQ ID NO: 891, SEQ ID NO:892 and SEQ ID NO:893, p. SEQ ID NO:907, SEQ ID NO: 908, SEQ ID NO: 909, SEQ ID NO: 911, SEQ ID NO:912 and SEQ ID NO:913, q. SEQ ID NO:927, SEQ ID NO: 928, SEQ ID NO: 929, SEQ ID NO: 931, SEQ ID NO:932 and SEQ ID NO:933, and r. SEQ ID NO:947, SEQ ID NO: 948, SEQ ID NO: 949, SEQ ID NO: 951, SEQ ID NO:952 and SEQ ID NO:953.

5. A vector comprising the polynucleotide according to claim 4.

6. An isolated cell comprising the polynucleotide of claim 4.

7. A pharmaceutical composition comprising the isolated anti-CCR8 antibody or antigen-binding fragment of claim 2 and a pharmaceutically acceptable excipient.

8. A pharmaceutical composition comprising the isolated anti-CCR8 antibody or antigen-binding fragment of claim 1 and a pharmaceutically acceptable excipient.

9. The isolated anti-CCR8 antibody or antigen-binding fragment thereof of claim 1, wherein the heavy chain variable region (VH) comprises CDRs 1, 2 and 3 with the amino acid sequences set forth in SEQ ID NOs: 618, 619, and 620, respectively, and the light chain variable region (VL) comprises CDRs 1, 2, 3 with the amino acid sequences set forth in SEQ ID NOs: 622, 623, and 624, respectively.

10. The isolated anti-CCR8 antibody or antigen-binding fragment thereof of claim 1, wherein the heavy chain variable region (VH) comprises an amino acid sequence at least 98% identical to the amino acid sequence set forth in SEQ ID NO: 617 and the light chain variable region (VL) comprises an amino acid sequence at least 98% identical to the amino acid sequence set forth in SEQ ID NO: 621.

11. The isolated anti-CCR8 antibody or antigen-binding fragment thereof of claim 10, wherein the VH comprises an amino acid sequence set forth in SEQ ID NO: 617 and the VL comprises an amino acid sequence set forth in SEQ ID NO: 621.

12. The isolated anti-CCR8 antibody or antigen-binding fragment thereof of claim 1, wherein the heavy chain comprises an amino acid sequence at least 98% identical to the amino acid sequence set forth in SEQ ID NO: 633 and the light chain comprises an amino acid sequence at least 98% identical to the amino acid sequence set forth in SEQ ID NO: 634.

13. The isolated anti-CCR8 antibody or antigen-binding fragment thereof of claim 12, wherein the heavy chain comprises an amino acid sequence set forth in SEQ ID NO: 633 and the light chain comprises an amino acid sequence set forth in SEQ ID NO: 634.

14. A method for inducing antibody-dependent cellular phagocytosis (ADCP) in a target cell expressing CCR8 comprising administering to a human patient having a tumor a therapeutically effective amount of the isolated anti-CCR8 antibody or antigen-binding fragment thereof of claim 1.

15. The method of claim 14, wherein the isolated anti-CCR8 antibody or antigen-binding fragment thereof comprises six CDR sequences that have the amino acid sequences set forth in SEQ ID NO:618, SEQ ID NO:619, SEQ ID NO:620, SEQ ID NO:622, SEQ ID NO:623 and SEQ ID NO:624.

* * * * *